United States Patent 12,508,308 (INFLUENZA mRNA VACCINES) - sequence listing, part 38

SEQ ID NO: 146426 - RNA, 1410 nt, Artificial Sequence
  derived and/or modified sequence opt3 from neuraminidase__InfluenzaA__AHJ57440
augaaccccaaucagaagaucauuaccauaggcagcgugucccugaucauuucuacaaucugcuucuuuaugcagauugccauccucauaacuacggucacccuucacuucaaacaguacgaguuuaacucaccuccaaauaaccagaugaugcugugugaaccgacaaucauugagagaaauaucacugaaauuguuuauuugaccaacacaaccaucgagaaggaaauaugccccaaaccugcugaguacaggaauuggaguaagccacagugugacauuacuggguucgcacccuuuagcaaagauaacuccauccgguuaucugccggaggugacauuugggugacacgcgagccuuauguaucgugcgauccagacaaguguuaccaauucgcgcugggccaggggaccacgcuaaauaacggacauucaaauaacacugugcgagaucguacccccuauagaacacuccugaugaaugaacuuggcgucccuuuucaccuggguacuaaacaggugugcaucgcuuggagcaguuccucuugucaugacgggaaggccugguugcacguuugcaucaccggagaugacaagaacgcaacagccagcuucauuuacaauggcaggcucguggauuccgucgugucauggaguaaagagauacugcggacccaggaaagcgaguguguaugcaucaacggcacguguacuguugugaugacagacgggucugcuuccggaaaggcagauaccaaaauucuguuuaucgaggaagguaagauaguccauacuucaacacucagcggcagugcccaacacguggaggaaugcucuugcuauccacgcuacccgggggugagaugugucugcagggacaacuggaagggauccaaucggcccauuguugauaucaacaucaaagaccacagcauugugucgucuuacguauguuccggcuuagugggugacaccccucgcaagaaugauucaaguagcuccucucauugccuggacccaaacaaugaggaagggggacacggcgucaaaggcugggcuuucgaugacgggaacgauguguggaugggacgaacgaucaaugagaccagcagacuugguuaugagacauuuaagguuauugaaggcuggucaaaccccaaaaguaaguugcagauaaauaggcaagugaucgucgaccguggggaucgguccggauacagcggcauuuucucuguggaggguaaaucauguaucaaccgcugcuuuuauguagaacugaucagagggaggaaggaggaaacugagguucuauggaccaguaauagcauuguggucuucuguggcacauccggaacuuacggcaccgggucuuggccugacggagccgauauaaaccucaugccaaucuga

SEQ ID NO: 146427 - RNA, 1410 nt, Artificial Sequence
  derived and/or modified sequence opt3 from neuraminidase__InfluenzaA__AHJ57441
augaaccccaaucagaagaucauuaccauaggcagcgugucccugaucauuucuacaaucugcuucuuuaugcaaauugccauccucauaacuacggucacccuucacuucaaacaguacgaguuuaacucaccuccaaauaaccagguuaugcugugugaaccgacaaucauugagagaaauaagacugaaaucguguauuugaccaacacaaccauugagaaagaaaucugccccaagccugcugaguacaggaauuggaguaaaccacagugugacauaacuggguucgcacccuuuagcaaggauaacuccauucgguuaucugccggaggugacaucuggguaacacgcgagccuuaugugucgugcgauccagacaaguguuaccaauucgcgcugggccaggggaccacgcuaaauaacguccauucaaauaacacugugcacgaucgaacccccuaucguacacuccugaugaaugaacuuggaguuccuuuucaucugggcacuaaacaggugugcauugcuuggagcaguuccucuugucacgacgguaaggccugguugcaugucugcaucaccggggaugacaaaaacgcaacagccagcuucaucuacaauggaagacucguggauuccguaguuucauggaguaaggagauucugaggacccaggaaagcgagugugugugcauaaacggcacguguacugucgugaugacagacggcucugcuuccgggaaagcagauaccaagauccuguuuauugaggaaggaaagaucgugcacacuucaacacucagcgguagugcccaacacgucgaggaaugcucuugcuauccacgguacccgggcguucgcugugugugcagagacaacuggaaaggguccaauaggcccauaguagauauuaacaucaaggaccauagcaucgugucgucuuacgucuguuccggauuagugggcgacaccccucggaaaaaugauucaaguagcuccucucacugccuggacccaaacaaugaggaaggugggcauggaguuaagggcugggcuuucgaugacggcaacgauguguggauggggcgcacgauuaaugagaccagccgacuuggauaugagacauuuaaagucaucgaagguuggucaaaccccaagaguaaauugcagauuaauagacaggugauaguagacaggggcaaccgguccggguacagcggaaucuucucuguugagggcaagucauguauuaaucguugcuuuuauguggaacugauccgcgguagaaaggaggaaacugagguccuauggaccaguaacagcaucguggucuucugugggacauccggcacuuacggaaccggcucuuggccugauggggccgacauuaaucucaugccaauauga

SEQ ID NO: 146428 - RNA, 1413 nt, Artificial Sequence
  derived and/or modified sequence opt3 from neuraminidase__InfluenzaA__AHJ57654
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacaacuaccaucauaaacaaucauccgcaaaacaauuucacaaacaucaccaauauuaucaugaacaagaaugaagagggcaacuuucugaaccuaacuaaaccccucugugaaguaaauuccuggcacauucugucuaaggauaacgcaaucagaauaggggagaaugcccauauucuugugacaagggaaccuuaucugucgugcgacccacagggaugucggauguucgcguugucacagggcaccacgcuccgcggucgacacgcuaacgggacuauccaugaucguagccccuuuagagcccugauuaguugggagaugggacaggcaccuuccccauacaaugccaggguggagugcaucggcuggucuagcaccuccugucacgacggcaucucacggaugaguauuugcauaagcgggcccaacaauaacgcuucugcagucgugugguauggaggucgcccuguuacagaaaucccauccugggccggcaauauucugagaacucaagagucagaaugugugugccacgggggaaucuguccggucgugaugaccgauggccccgcuaacaauagggccgagacaaaaauaauuuacuucaaggaggguaagguacagaaaaucgaggagcucaaggggaacgcgcagcauaucgaagagugcagcuguuauggagcaaguggcaugauuaaaugcaucugccgggacaauuggaagggcgccaaccgcccuguuauuaccauagauccagaaaugaugacgcacacuucuaaauacuuauguuccaagauccugacagacaccagccgacccaaugauccuacuaacgggaacugcgacgcuccaauuacaggagguucgcccgauccgggcgugaagggguuugccuuccuugacggagaaaauucuugguugggcagaaccaucuccaaagauucaaggagugguuaugagaugcugaagaucccuaacgcagaaacggacacccagagcggggcuauuucccaucaaauaaucgucaauaaccagaauuggucuggcuacagcggagccuuuauugacuacugggcgaacaaagaguguuucaaucccugcuuuuauguggaacuaauccggggccguccaaaggagucaagugugcucuggacauccaacagcauugucgcccugugugggucucgcgaaagacuuggaucauggaguuggcacgauggugcagagaucauauacuucaaauga

SEQ ID NO: 146429 - RNA, 1410 nt, Artificial Sequence
  derived and/or modified sequence opt3 from neuraminidase__InfluenzaA__AHJ57666
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaguucgcgcuaggacaaggcaccacgcucgacaacucacacagcaaugguacuauucaugaucgaaucccucaccguacccugcuuaugaacgaacugggggucccauuucauuugggaacaaaacaggugugcauugcuuggaguuccucuagcugucacgacggcagagccuggcuccacaucugcaucacuggcgaugacaggaaugcaaccgccuccuucauuuacgaugggaugcugguagacucaauaggaaguuggagcaagaacauccugcggacacaggagucugaauguguuugcauuaaugguaccugugcuguggucaugacggauggcuccgcaucagggguggccgacacucgcauccucuuuauaagagagggaaagauugugcauaucagccccuuaaguggcucugcucagcacaucgaggaaugcuccugcuauccuagguacccagauguccgguguguuugccgcgacaacuggaaagguagcaaccgaccggugauugauaucaauauggccgacuauucgauugacucuaacuacguauguuccgggcuggugggagauacacccagaaaugacgauaacucaaguagcuccaauugcagggacccuaacaaugagcggggcaacccaggcgucaaggggugggcguucgaugacggaaaugauguguggaugggucguaccauaaaccgcgacucuagaagcggcuacgaaacuuuuaggguuaucgggggauggacaaccgcaaauucaaagagucaaauuaaccgacaggugaucgucgauaauaacaauugguccggcuauagcgguguguucucuguagaggggaaaucauguaucaaccggugcuuuuacguugaacuuauuaagggccgcccccaggagccuagagugugguggacgaguaacagcauagucguguucuguggaaccuccggcacauaugggacuggaucuuggccagacggugccaauaucaacuuuaugcccauuuga

SEQ ID NO: 146430 - RNA, 1413 nt, Artificial Sequence
  derived and/or modified sequence opt3 from neuraminidase__InfluenzaA__AHJ57677
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaacaugaaugagaccagcccaacaacuaccgugaucaacaaucauccgcaaaacaauuucacaaacauaaccaauaucauuguaaacaagaaugaagaggaaaacuuuuuaaaccugacuaaaccccuaugugaggucaauuccuggcacauccucucuaaggauaacgcaauuagaaucggcgaaaaugcccauauacuggugacaagggagccuuaucuuucgugcgacccacaggggugucggauguucgcgcugucacagggaaccacguugcgcggccagcacgcuaacgguacuauucaugaucgaagccccuuucgugcccucaucaguugggagauggggcaagcaccuuccccauacaaugccagaguggaaugcauuggauggucuagcaccuccugucacgacggcaucucaaggaugaguaucugcauuagcggccccaacaauaacgcuucugcaguugugugguaugggggacggccugucacagagauaccauccugggccgguaauauccugcgcacucaggaaucagagugugugugccacggcgggauuuguccgguaguuaugaccgauggacccgcuaacaauagagccgagacaaaaaucauauacuucaaggaaggcaagauucagaaaguggaggaacugaaggguaacgcgcagcauaucgaggaaugcagcuguuauggggcaaguggaaugaucaaaugcauuugcagggacaauuggaagggcgccaaccggccugucaucaccauugauccagagaugaugacgcacacuucuaaauaccucuguuccaagauauuaacagacaccagccgccccaaugauccuacuaacggcaacugcgacgcuccaaucacagggggaucgcccgauccgggugugaagggcuuugccuuccuggacggggaaaauucuuggcuuggacgaaccauuuccaaagauucaagaaguggcuaugagauguugaaggugccuaacgcagagacggacacccaaagcggugcuaucucccaucagaugaucgucaauaaccagaauuggucuggguacagcggcgccuuuauugacuacugggcgaaaaaggaauguuucaaccccugcuuuuauguugagcugauaaggggacggccaaaagaaucaagugugcuauggacauccaauagcaucguagcccucuguggcucucgugagcgccuggggucauggaguuggcacgauggagcagagauuaucuacuucaaguga

SEQ ID NO: 146431 - RNA, 1413 nt, Artificial Sequence
  derived and/or modified sequence opt3 from neuraminidase__InfluenzaA__AHJ57689
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaagaugaacgagaccagcccaacaacuaccaucauaaauaaccauccgcaaaauaacuucacaaauaucaccaacauuaucgugaauaaaaacgaagaggaaaacuuuuuaaaucugacuaagccccuaugugagguaaacuccuggcacauucucucuaaagauaaugcaaucagaauaggcgaaaacgcccauauucuggugacaagggagccuuaucuuucgugcgacccacaggggugucggauguucgcgcugucacagggaaccacguugcgcggccagcacgcuaaugguacuauccaugaucgaagccccuuucgugcccucauuaguugggagauggggcaagcaccuuccccauacaacgccagagucgaaugcaucggauggucuagcaccuccugucacgacggcaucucaaggaugaguauuugcauaagcggccccaauaacaaugcuucugcagugguuugguaugggggacggccugugacagagaucccauccugggccgguaacauucugcgcacucaggaaucagagugugucugccacggcgggaucuguccggugguaaugaccgauggacccgcuaauaacagagccgagacaaagauaauuuacuucaaggaaggcaaaauccagaagaucgaggaacugaaagguaaugcgcagcauauugaggaaugcagcuguuauggggcaaguggaaugaucaagugcauuugcagggacaacuggaaaggcgccaaucggccuguuauaaccaucgauccagagaugaugacgcacacuucuaaguaccucuguuccaagauuuuaacagacaccagccgccccaacgauccuacuaauggcaacugcgacgcuccaaucacagggggaucgcccgauccgggugugaaaggcuuugccuuccuggacggggagaacucuuggcuuggacgaaccaucuccaaggauucaagaaguggcuaugaaauguugaaagucccuaaugcagagacggacacccaaagcggugcuauuucccaucagauaaucgugaacaaucagaacuggucuggguacagcggcgccuuuauugacuacugggcgaauaaggaauguuucaaccccugcuuuuauguggagcugaucaggggacggccaaaagaaucaaguguccuauggacauccaauagcauuguugcccucuguggcucucgugagcgccuggggucauggaguuggcacgauggagcagagaucauauacuucaaguga

SEQ ID NO: 146432 - RNA, 1413 nt, Artificial Sequence
  derived and/or modified sequence opt3 from neuraminidase__InfluenzaA__AHJ57700
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacaacuaccaucauaaacaaucauccgcaaaacaauuucacaaacaucaccaauauuaucaugaacaagaaugaagagggcaacuuucugaaccuaacuaaaccccucugugaaguaaauuccuggcacauucugucuaaggauaacgcaaucagaauaggggagaaugcccauauucuugugacaagggaaccuuaucugucgugcgacccacagggaugucggauguucgcguugucacagggcaccacgcuccgcggucgacacgcuaacgggacuauccaugaucguagccccuuuagagcccugauuaguugggagaugggacaggcaccuuccccauacaaugccaggguggagugcaucggcuggucuagcaccuccugucacgacggcaucucacggaugaguauuugcauaagcgggcccaacaauaacgcuucugcagucgugugguauggaggucgcccuguuacagaaaucccauccugggccggcaauauucugagaacucaagagucagaaugugugugccacgggggaaucuguccggucgugaugaccgauggccccgcuaacaauagggccgagacaaaaauaauuuacuucaaggaggguaagguacagaaaaucgaggagcucaaggggaacgcgcagcauaucgaagagugcagcuguuauggagcaaguggcaugauuaaaugcaucugccgggacaauuggaagggcgccaaccgcccuguuauuaccauagauccagaaaugaugacgcacacuucuaaauacuuauguuccaagauccugacagacaccagccgacccaaugauccuacuaacgggaacugcgacgcuccaauuacaggagguucgcccgauccgggcgugaagggguuugccuuccuugacggagaaaauucuugguugggcagaaccaucuccaaagauucaaggagugguuaugagaugcugaaggucccuaacgcagaaacggacacccagagcggggcuaucucccaucaaauuauagugaauaaccagaauuggucuggcuacagcggagccuuuaucgacuacugggcgaacaaagaguguuucaaucccugcuuuuauguggaacuaauucggggccguccaaaggagucaaguguccucuggacauccaacagcaucguugcccugugugggucucgcgaaagacuuggaucauggaguuggcacgauggugcagagauuaucuacuucaaauga

SEQ ID NO: 146433 - RNA, 1410 nt, Artificial Sequence
  derived and/or modified sequence opt3 from neuraminidase__InfluenzaA__AHJ57710
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaguucgcgcuaggacaaggcaccacgcucgacaacucacacagcaaugguacuauucaugaucgaaucccucaccguacccugcuuaugaacgaacugggggucccauuucauuugggaacaaaacaggugugcauugcuuggaguuccucuagcugucacgacggcagagccuggcuccacaucugcaucacuggcgaugacaggaaugcaaccgccuccuucauuuacgaugggaugcugguagacucaauaaguagcuggucuaagaacauccugcggacacaggaguccgaauguguuugcauuaauggaaccugugcuguggucaugacggaugguucagcaagcggcguggccgacacucgcauccucuuuauaagagaggggaagauugugcauaucagucccuuaucuggauccgcucagcacaucgaggaaugcagcugcuauccuagguacccagauguccgguguguuugccgcgacaacuggaaaggcucgaaccgaccggugauuaauaucaacauggccgauuauucuauugacuccaauuacguauguucaggucuggugggggacacacccagaaacgaugacaauaguagcuccucuaacugcagggauccuaauaacgagcggggaaauccaggcgucaagggcugggcguucgacgaugggaacgacguguggaugggacguaccauaaaucgcgauagcagaucagguuacgaaacuuuuaggguuaucggcggguggacaaccgcaaacaguaagucccaaauuaaucgacaggugaucgucgacaacaauaacuggagcggauauucuggcguguucucaguagaggguaaaaguuguaucaaccggugcuuuuacguugaacuuauucgcgggagaccccaggagccuagggugugguggacgagcaauuccauagucguguucuguggcaccucuggaacauauggcacugggucguggccagauggagccaacaucaauuuuaugcccauuuga

SEQ ID NO: 146434 - RNA, 1410 nt, Artificial Sequence
  derived and/or modified sequence opt3 from neuraminidase__InfluenzaA__AHJ57734
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucgcagaguauaggaacuggaguaaaccucaguguaagauuacuggguucgccccauuuagcaaggacaauuccauccgguuaucugcgggaggugauauaugggugacacgcgagcccuacguuucgugcggccuggggaaauguuaucaguucgcucuaggacaaggcaccacgcucgacaacucacacagcaaugguacuauucaugaucgaaucccucaccguacccugcuuaugaacgaacugggggugccauuucauuugggaacaaagcaggucugcauugccuggaguuccucuagcugucacgacggcagagcauggcuccacaucugcaucacuggcgaugacaggaaugccaccgcuuccuucauuuacgaugggaugcugguggacucaauaggaaguuggagcaaaaacauccugcggacacaggagucugaauguguaugcauuaaugguaccugugcaguugugaugacggauggcuccgccucaggggucgcugacacucgcauccucuuuauaagagagggaaagauugugcauaucagccccuuaaguggcucugcccagcacaucgaggaaugcuccugcuauccuagguacccagaugugcggugugucugccgcgacaacuggaaagguagcaaccgaccgguuauuaauaucaacauggcggauuauucgauugacucuaauuacguguguuccgggcugguaggagacacacccagaaacgaugacaauucaaguagcuccaacugcagggauccuaauaacgagcggggcaauccaggcgugaaggggugggcauucgacgauggaaacgacgucuggaugggucguaccauaaaucgcgauucuagaagcggcuacgaaacuuuuagggugaucgggggauggacaaccgccaacucaaagagucaaauuaaucggcagguuaucguggacaacaauaacugguccggcuauagcggugucuucucuguggaggggaaaucauguaucaaccgaugcuuuuacguagaacuuauucgcggcagaccccaggagccuaggguuugguggacgaguaauagcauaguggucuucuguggaaccuccggcacauaugggacuggaucuuggccagauggugcuaacaucaauuuuaugcccauuuga

SEQ ID NO: 146435 - RNA, 1380 nt, Artificial Sequence
  derived and/or modified sequence opt3 from neuraminidase__InfluenzaA__AHJ57746
augaaccccaaucagaagaucauuaccauaggcagcguguccaucacaauugccgcugucugcuuccugaugcaaaucgcaauucucgccacuacgguuacccuucacuuuaaacagaacgaguguaauaucccuucuaagaaccaugugauaccaugcgaaccgaucauuaucgagagaaauauuacagaaguagagaucaggcccaaaguggcggaauaccgggacuggucaaagccucagugucagauaacuggguucgcuccauuuaguaaagauaacagcauucgccuguccgccggagguaauaucugggucacccgagagcccuaugugucuugcggcccugacaaguguuaccaauucgcauuggggcagggaacaaccuuaggcaacggucacucgaaugggacuauucaugauaagaucccacaccguacacugcuaaugaacgagcucggaguucccuuucaucugggcaccaaacaggugugcaucgccuggucaagcaguuccugucacgacggcagagcuuggcuucacgucugcgugacgggggaugacaggaaugcaacugccucuuucauuuaugauggaaugcugguagacagcauagcuuccuggucacagaacaucuugcggacccaagaaagugaguguguuugcauuaaugguacauguacuguggucaugaccgauggcagcgccucugggguggcggacacacgcauccucuuuauaagagaaggaaagauugugcauaucuccccucugucaggcagcgcacagcacaucgaggagugcaguugcuacccaaggcauucugauguccgguguguuugccgcgacaacuggaaagguuccaaucgaccggugguagauauuaacaugaccgacuauagcaucgacucgucuuacguguguuccgggcuggucggagauacgcccagaaacgacgauucaaguagcuccucuaauugcagggacccuaacaaugaacggggcaacccaggcgugaaggggugggccuucgaugacggagaugacguuuggaugggucguacuauuagccgcgauucaagaaguggcuaugagacauuuagggugauagggggauggaccacugcuaauuccaaaagccagaucaaccggcaggucauuguggacaauaacaauuggucuggcuacucagguguauucaguguugaaggcaagagcuguaucaaccgaugcuuuuacguggagcucauccgcgggagaccccaagaaacaagggucugguggaccuccaauucuauuguggucuucuguggaacgucgggcaccuaugggacaggaagcuggccugauggugccaacauaaauuuuaugccaaucuga

SEQ ID NO: 146436 - RNA, 1410 nt, Artificial Sequence
  derived and/or modified sequence opt3 from neuraminidase__InfluenzaA__AHJ57758
augaaccccaaucagaagaucauuaccgugggcagcgucucccuggccauagcuacaaucugccuccuuaugcaaauugcaauccuggccacuacgguuaccuugcacuucaaacagaacgaguguaauauuccuucuaagaaccaggugaugccaugcgaaccgaucauaaucgagagaaauauuacagaaguaguguacuuaaacaauacuaucauugagaaagaaaucugucccaaggucguggaguauaggaacuggucaaaaccucagugccaaauaaccggguuugcgccauucaguaaggacaauagcauucggcuguccgcuggaggugauaucuggguuacacgcgagcccuacgugucuuguucgccuucaaagugcuaucaguuugcccuaggccaggggaccacucucgacaacagccauaguaauggaacaauucacgaucgaaucccacaucguacccugcuuaugaacgaacugggcguccccuuccacuuggguacgaaacagguguguaucgcaugguccucuagcuccugccaugacgggagagccuggcuccacguauguauuacuggagaugacaggaaugcuaccgcaucauuuauauacaacggcaugcugguugauaguaucagcucuuggucccggaauauucugcgcacacaagagucagaaugcguguguaucaacggcacuugcaccgucauaaugacagacgggagcgccaguggaguggcugauacccggauucucuucaucagggaggguaacaucgugcacgucucuccuuuauccggcagcgcccagcauauugaggaaugcucguguuauccacgguacccggacguucgcugcgugugucgagauaauuggaaggggucuaacagacccguaguggacaucaauauggcggauuauuccauugacucacacuacgucugcaguggacuggugggcgacacgccuaggaacgaugacagcuccucuagcucaaauuguaaagauccaaacaaugagcgggguaaccccgggguuaagggaugggcauuugacgauggcaaugacguguggaugggccguacuauaagucgcgauuccagaagcggguacgaaacauucagggucaucggagguuggaccacugccaacucuaaaucacagauuaauagacaggugaucguagacaacaauaacuggaguggcuauagcgggguguuuuccguugagggaaagucuugcaucaaucgauguuucuacgucgaacuuauucgcggcagaccucaagagacaagggugugguggaccucgaacagcauagucguguuuugcgguacguccgggaccuauggcacaggaucauggccagauggcgcuaacaucaauuucaugcccauuuga

SEQ ID NO: 146437 - RNA, 1401 nt, Artificial Sequence
  derived and/or modified sequence opt3 from neuraminidase__InfluenzaA__AHJ57770
augaaccccaaucagaagaucauugccauaggcagcgugucccugaccaucgcuauuaucugcuuccucaugcaaauugcaauccuuacaacuacgaugacccugcacuuuaaacagaacgaguguucuaauccuucaaacaaucaggucguuccaugcgaaccgauaaucauugagagaaacacagugcauuugaauaguacuaccaucgaaaaggagauuugucccaaaguaguggaauacaagaacuggagcaaaccucagugccaaaucacaggguucgccccauuuuccaaggacaauucuauaagguuaucggcgggaggugauauuugggucacccgggagcccuaugugucauguagccugggcaagugcuaccaguucgcucuagggcagggaacuacacucaaaaacaagcacaguaauggcaccacgcaugaccgcaucccucaccgaacucugcuuaugaacgagcuggguguuccauuucauuuggggaccaaacagguguguauugccugguccucuagcuccugcuaugauggaaaggcauggcuccacaucugugucacaggcgacgauaaaaaugccacugcuucaaucauuuacgacggcaugcugguggauaguauagggagcuggucuaagaacauccugcguacccaagaauccgagugcguauguauuaauggaacaugcgcaguugugaugaccgacgguucagccagcggcaaggcugauacgagaauccucuucauaagggaagggaaaauuaucaacaucagucccuuaucuggauccgcccagcacgucgaggagugcagcuguuauccucgguacccagaagugcgcugcguguguagagacaacuggaagggcucgaauaggccgguccuguauauuaacauggcggauuacucuguugaguccucauacgugugcaguggucuuguaggggacacuccccggaaugaugacagcuccucuagcucaaacugucgcgacccuaauaacgaacgaggagcaccaggcgugaaaggcugggccuuugaugacgggaaugaugucuggaugggaagaacaaucaagaacgacaguagguccgguuaugagaccuuccgggugguuaauggcuggacuacagcuaacagcaaaucucagauuaaucgucaggugauagucgauucagaaaacuggaguggguacagcggaaucuuuuccguggagggcaagaauugcauuaaccgcuguuucuauguagaguugaucagagguaggccccaagaaccucggguuugguggaccucuaauucgaucauuguguuuugcgggacgagcggcaccuacggaacaggcuccuggccagacggggccaacauaaacuuccugcccaucuga

SEQ ID NO: 146438 - RNA, 1410 nt, Artificial Sequence
  derived and/or modified sequence opt3 from neuraminidase__InfluenzaA__AHJ57782
augaaccccaaucagaagaucauuauaaucggcagcguuucccugaccauugccacagucugcuuccucaugcaaaucgcuauucuugcaacuacgguuacccugcacuuuaaacagaacgaguguaauaucccuucuaagaaccaggugguaccaugcgaaccgauaaucauugagagaaauaucacagaaguggucuacuugaacaauacuaccauugagaaagaaaucugucccgccgugguugaguauaggaacuggucaaagccucagugccaaauaaaaggguucgcgccauuuaguaaggacaauagcauucgguuauccgcuggaggugauaugugggugacacgcgagcccuacgucucuuguucgccuucaaagugcuaucaguucgcccugggccaggggaccacucuagacaacaaucauagcaacggaacaauccacgaucguauuccacaucgaacccuccugaugaaugaacuuggcgugcccuuucaccuggguacgaaacagguauguaucgcauggaguuccucuagcugccaugacgggaaggccugguugcacguuugugugacuggagaugacagaaacgcuaccgcauccuucaucuacgauggcaugcucgucgacucaauuggcaguuggagccaaaauauacugaggacacaggagucugaaugcguguguaucaacgggacuugcaccguggucaugacagauggauccgccucagguauugcugacacccggauccuguuuguucgcgagggcaaaauagugcacauuagcccucucagugggucugcccagcauaucgaggaaugcuccuguuauccaagauacccggauguaaggugcgugugucgggacaacuggaagggaagcaaucgccccaucgucgauauuaacauggcggacuauucgaucgguucuuccuacgugugcucaggcuuaguuggggacacgccucgaaaugaugacagauucaguagcuccaacuguagggauccaaauucugagcggggaaaccccggcgugaaaggcugggcauuugacgauggggacgaugucuggaugggacguacuauuagccgcgacucaagaagugguuacgaaacauucagggugauaggcggguggaccacugccaauuccaagagccagaucaaccggcaaguaauuguugauaauaacaauuggucuggauauucaggcguguuuagugucgaggguaagagcugcaucaaccgauguuucuacguggaacugauccgcgggagaccucaggagacaagggucugguggaccuccaauucuauugugguguuuugcggcacgucgggaaccuauggcacagggagcuggccagacggagcuaacauaaauuucaugcccaucuga

SEQ ID NO: 146439 - RNA, 1410 nt, Artificial Sequence
  derived and/or modified sequence opt3 from neuraminidase__InfluenzaA__AHJ57794
augaaccccaaucagaagaucauuaccgugggcagcgucucccuggccauagcuacaaucugcuuccucaugcaaauugcaauccuugccacuacgguuacccugcacuuuaaacagaacgaguguaauauuccuucuaagaaccaggugaugccaugcgaaccgaucauaaucgagagaaauauuacagaaguaguguacuugaacaauacuaucauugagaaagaaaucugucccaaggucguggaguauaggaacuggucaaaaccucagugccaaauaaccggguucgcgccauuuaguaaggacaauagcauucgguuauccgcuggaggugauaucuggguuacacgcgagcccuacgugucuuguucgccuucaaagugcuaucaguucgcccugggccaggggaccacucuagacaacagccauaguaauggaacaauucacgaucgaaucccacaucguacccuccugaugaacgaacuuggcguccccuuucaccuggguacgaaacagguguguaucgcaugguccucuagcuccugccaugacgggagagccugguugcacguauguauuacuggagaugacaggaaugcuaccgcaucauucauauacaacggcaugcucguugauaguaucagcucuuggucccggaauauucugcgcacacaagagucagaaugcguguguaucaacggcacuugcaccgucauaaugacagacgggagcgccaguggaguggcugauacccggauucuguuuaucagggaggguaacaucgugcacgucucuccucucuccggcagcgcccagcauauugaggaaugcucguguuauccacgguacccggacguucgcugcgugugucgagauaauuggaaggggucuaacagacccguaguggacaucaauauggcggauuauuccauugacucacacuacgucugcaguggauuagugggcgacacgccuaggaacgaugacagcuccucuagcucaaauuguaaagauccaaacaaugagcgggguaaccccgggguuaagggaugggcaagugacgauggccaugacguguggaugggccguacuauagggcgcgauuccagaagcggauacgaaacauucagggucaucgguggcuggaccacugccaauucuaaaucacagauuaacagacaggugaucguagacaauaacaauuggaguggguauagcggaguguuuuccguugagggcaagucuugcaucaaccgauguuucuacgucgaacugauucgcgguagaccucaagagacaagggugugguggaccucgaauagcauagucguguuuugcgggacguccggcaccuauggaacaggcucauggccagauggggcuaacaucaacuucaugcccauuuga

SEQ ID NO: 146440 - RNA, 1413 nt, Artificial Sequence
  derived and/or modified sequence opt3 from neuraminidase__InfluenzaA__AHJ57806
augaaccccaaucagaagauuaccugcaucagcgccacaggcaugacucuguccguggucucucuccuuacggggauagcuaaccugggauugaauaucgguuuacacuacaaaguuucagacaguaccaacauuagcaucccuaauaugaacgaggcauccccaacaacuaccauuaucaauaaccauccgcaaaauaacuucacaaauauaaccaacaucauuaugaauaagaacgaagagggcaauuuucugaaccuaacuaaaccccucugugaagugaacucuuggcacauccugucgaaggauaaugccauuagaaucggggagaacgcgcauauacuuguaacaagggaaccuuaucugucaugcgacccacagggaugucggauguucgcuuugagccagggcaccacgcuccgcggucgacacgccaaugggacuauucaugaucguagucccuuuagagcacugaucuccugggagaugggacaggccccuucuccauacaacgcuaggguggagugcauuggcuggagcuccaccucaugucacgacggcaucagucggaugagcaucugcauuucugggcccaauaacaaugcauccgccgucgugugguauggaggucgcccuguuacagaaauaccaucaugggcuggcaacauccugagaacucaagagagcgaaugugugugccacgggggaauuuguccggucgugaugaccgauggccccgccaauaacagggcggagacaaaaaucauauacuucaaggaggguaagauucagaaaaucgaggaacucaaggggaaugcacagcauaucgaagagugcaguuguuauggagccucuggcaugauuaaaugcaucugccgggacaacuggaagggcgcuaaucgcccuguaauuaccauagauccagaaaugaugacgcacacuuccaaauacuuauguagcaagauccugacagacaccucgcgacccaacgauccuacuaaugggaacugcgacgccccaauuacaggagguucucccgauccgggcguuaagggguuugcauuccuugacggcaaaaacuccugguugggaagaaccaucucaaaggauaguaggagcgguuaugagaugcugaaagugccuaaugcugagacggacacccaguccggggccaucucucaucaaauuauagucaacaaucagaacuggagcggcuacucaggagcguuuaucgacuacugggccaauaaggaauguuucaaccccugcuuuuauguggagcuaauucggggccguccaaaagaaaguuccgugcucuggacaagcaauucuaucgucgcacugugugggucacgcgagagacuuggaaguuggagcuggcacgauggugcugaaauuaucuacuucaaguga

SEQ ID NO: 146441 - RNA, 1380 nt, Artificial Sequence
  derived and/or modified sequence opt3 from neuraminidase__InfluenzaA__AHJ57818
augaaccccaaucagaagauuaccugcaucagcgccacaggcgugacucuguccgucguuucucuccuuauagggaucgcuaaccugggauugaauauugguuuacacuacaaagugucagacaguccuacgaucaacauuccaaauaugaacgagaccaauccgaucacaacuaacauaaccaauaucauuguaaacaagaaugaagagggcacauuccugaaccuaaccaaaccccucugugaagugaauagcuggcauauccuguccaaggauaacgcaauuagaaucggggaggacgcccacauacuugucacuagggaaccuuaucugucuugcgauccacaaggaugucggauguuugcguugucgcagggcacaacccuccgcggucgacaugcuaaugggacgauucacgaccguucacccuucagagcccugaucagcugggagaugggacaggcaccuaguccauacaacacuaggguggagugcauuggcugguccucuaccagcugucaugauggcaucucccggaugucaaucugcauuagugggcccaacaauaacgccagcgcuguugugugguaucgcggaagaccugucacagaaauaccaucuugggcagguaauauccugaggacucaggaguccgaaugugugugccacaaaggcauuuguccgguaguuaugaccgacgggcccgccaacaauaaggcugccacaaagaucauauacuuuaaagagggaaagauucagaaaaucgaggaacuccaaggcaacgcgcagcacaucgaggaaugcucauguuauggugcagccgggaugauuaagugcgugugccgggauaauuggaaaggagcuaaccgcccuaucauuaccauagacccagagaugaugacgcauacuagcaaguacuuauguaguaagauccugacagauaccucucgacccaaugacccuacugauggcaacugcgacgccccaauuacaggcgggucccccgauccgggagucaaagguuucgcauuucuugaaggcgagaauagcugguuggggagaaccaucucgaaggacucuagguccggauaugagaugcugaaagugccuaacgcugaaacggacacccagucaggcgccaucagucaccaaaugauugugaauaaccagaauuggagcgguuacuccggggcguucauagauuacugggccaacaaggaguguuuuaaccccugcuucuaugucgaacuaauccggggccguccaaaagagucuagcguucucuggacaucaaauaguauuguggcacuguguggaucccgcgaaagacuuggcagcuggucuuggcaugacggggcugagaucauuuacuuuaaguga

SEQ ID NO: 146442 - RNA, 1410 nt, Artificial Sequence
  derived and/or modified sequence opt3 from neuraminidase__InfluenzaA__AHJ57830
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccaucgagaaagaaauuugccccaagguggucgaguauaggaacuggaguaaaccucaguguaagaucacuggguucgcaccauuuagcaaggacaauuccauacgguuaucugccggaggugauauuugggugacacgcgagcccuacguuucgugcggccuggggaaauguuaucaguucgcgcuaggacaaggcaccacgcucgacaacucacacagcaaugguacuauccaugaucguauuccucaccgaacccugcuuaugaacgaacugggggugccauuucauuugggaacaaagcaggucugcaucgcuuggaguuccucuagcugucacgacggcagagccuggcuccacaucugcauuacuggcgaugacaggaaugcaaccgccuccuucauauacgaugggaugcugguggacucaaucggaaguuggagcaaaaacauucugcggacacaggagucugaauguguaugcaucaaugguaccugugcuguugugaugacggauggcuccgcaucaggggucgccgacacucgcauacucuuuauuagagagggaaagaucgugcauaucagccccuuaaguggcucugcucagcacauugaggaaugcuccugcuauccuagguacccagaugugcggugugucugccgcgacaacuggaaagguagcaaccgaccgguuaucgauauuaauauggccgacuauucgauagacucuaacuacguguguuccgggcugguaggagauacacccagaaaugacgauaacucaaguagcuccaauugcagggacccuaacaaugagcggggcaacccaggcgugaaggggugggcguucgaugacggaaaugaugucuggaugggucguaccaucaaccgcgacucuagaagcggcuacgaaacuuuuagggugauugggggauggacaaccgcaaauucaaagagucaaaucaaccggcagguuaucguggauaauaacaauugguccggcuauagcggugucuucucuguggaggggaaaucauguauuaaccgaugcuuuuacguagaacuuauacgcggcagaccccaggagccuaggguuugguggacgaguaacagcaucguggucuucuguggaaccuccggcacauaugggacuggaucuuggccagacggugccaauauuaacuuuaugcccaucuga

SEQ ID NO: 146443 - RNA, 1413 nt, Artificial Sequence
  derived and/or modified sequence opt3 from neuraminidase__InfluenzaA__AHJ57842
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaagaugaacgagaccaauccaacaacuaccaucauaaacaaucauccgcaaaacaauuucacaaacaucaccaauauuaucgugaacaaaaaugaagaggaaaacuuuuuaaaccugacuaagccccuaugugagguaaauagcuggcacauucucuccaaagauaacgcaaucagaauaggcgaaaaugcccauauucuggugacaagggagccuuaucuuucuugcgacccacaggggugucggauguucgcgcugucgcagggaaccacgauccgcggccagcacgcuaacgguacuauucaugaucgaucacccuuucgugccuugaucagcugggagauggggcaagcaccuaguccauacaaugccagagucgaaugcaucggaugguccucuaccagcugucacgacggcauuuccaggaugucaauaugcaucaguggccccaacaauaacgcuagcgcagugguuugguaugggggacggccugugacagagauuccaucuugggccgguaauauccuccgcacucaggaauccgagugugucugccacggcgggauauguccggugguaaugaccgauggacccgcuaacaauagagccgagacaaagauuaucuacuucaaggaaggcaaaauccagaagauugaggaacugaaagguaacgcgcagcauaucgaggaaugcucauguuauggggcaagcggaaugauuaagugcauaugcagggacaauuggaaaggcgccaaccggccuguuaucaccauugauccagagaugaugacgcacacuucuaaguaccuguguucuaagauccucacagacaccucccgccccaaugauccuacuaacggcaacugcgacgcuccaaucacagggggaagcucggaucccggugugaaaggcuuugccuucuuagacggggagaauaguuggcugggacgaaccauuuccaaggauucaagaaguggcuaugaaaugcuuaaagucccgaacgcagagacggacacccaaagcggugcuauaucccaucagaucauugugaauaaccagaauuggucuggguacagcggcgccuuuaucgacuacugggcgaacaaggaauguuucaauccuugcuuuuauguggaguugauuaggggacggcccaaagaaucaaguguccuguggacauccaacagcaucguugcccuauguggcucucgugagcgccucgggucauggaguuggcacgauggagcagagauaaucuacuucaaguga

SEQ ID NO: 146444 - RNA, 1413 nt, Artificial Sequence
  derived and/or modified sequence opt3 from neuraminidase__InfluenzaA__AHJ57853
augaaccccaaucagaagauuaccugcaucagcgccacaggcaugacucuguccguggucucucuccuuauagggaucgcuaaccugggauugaauguugguuuacacuacaaagugaacgacccuacgaauauuaacaucccaaauaugaacgagaccucaccgacaacuaccauuaucaauaaccauccccaaaauaacuucacaaauauaaccaacaucauuguaaauaagaacgaagaggaaaacuuucugaaucuaacuaaaccucucugugaggugaacaguuggcacauccugagcaaggauaaugcaauuagaaucggcgaaaacgcccauauacuugucacaagggagccauaucuguccugcgacccccaggggugucggauguucgcguugucucagggaaccacgcuccgcggccagcacgcuaaugguacuauucaugaucgaucgccuuuucgugcccugaucucaugggagauggggcaagcaccaagccccuacaacgccagaguggaaugcauuggauggaguuccaccucuugucacgacggcaucagcaggauguccaucugcauuucaggcccuaauaacaaugcuagugcaguugugugguaugggggacggccagucacagagauaccgagcugggccgguaacauccugcgcacucaggaaucugagugugugugccacggcgggauuugucccguaguuaugaccgauggaccugcuaauaacagagccgagacaaaaaucauauacuucaaggaaggcaagauucagaaaaucgaggaacucaaggguaaugcgcagcauaucgaggaaugcuccuguuauggggcaucaggaaugauuaaaugcaucugcagggacaacuggaagggcgccaaucggccagugauuaccauagaucccgagaugaugacgcacacuagcaaauacuuauguaguaagauccugacagacaccucucgcccuaacgauccaacuaacggcaauugcgacgcucccauuacagggggauccccggauccuggugucaagggcuuugccuuccuugacggggagaacagcugguugggacgaaccaucucgaaagauucuagauccggcuaugaaaugcugaaggugcccaaugcagagacggacacccaaucaggugcuaucagucaucagaugauugugaacaaucagaacuggagcggguacuccggcgccuuuauagacuacugggcgaauaaagaauguuucaacccaugcuuuuaugucgagcuaaucaggggacggccuaaggaaucuagcguucucuggacaucaaauaguauuguggcccuguguggcucccgugagcgccuugggagcuggucuuggcacgauggagcagagaucauuuacuucaaauga

SEQ ID NO: 146445 - RNA, 1413 nt, Artificial Sequence
  derived and/or modified sequence opt3 from neuraminidase__InfluenzaA__AHJ57865
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaagaugaacgagaccaauccaacaacuaccaucauaaacaaucauccgcaaaacaauuucacaaacaucaccaauauuaucgugaacaaaaaugaagaggaaaacuuuuuaaaccugacuaagccccuaugugagguaaauagcuggcacauucucuccaaagauaacgcaaucagaauaggcgaaaaugcccauauucuggugacaagggagccuuaucuuucuugcgacccacaggggugucggauguucgcgcugucgcagggaaccacguugcgcggccgacacgcuaacgguacuauccaugaucguucacccuuuagagcccucauuagcugggagauggggcaggcaccuaguccauacaaugccagggucgaaugcaucggaugguccucuaccagcugucacgacggcaucucccggaugucaauuugcauaaguggccccaacaauaacgcuagcgcagugguuugguaugggggacgcccugugacagagaucccaucuugggccgguaauauucugagaacucaagaauccgagugugucugccacggcgggaucuguccggugguaaugaccgauggacccgcuaacaauagggccgagacaaagauaauuuacuucaaggaaggcaaaauccagaagaucgaggaacugaaagguaacgcgcagcauauugaggaaugcucauguuauggggcaagcggaaugaucaagugcauuugccgggacaauuggaaaggcgccaaccgcccuguuauaaccaucgauccagagaugaugacgcacacuucgaaguaccucuguucuaagauuuuaacagacaccucccgacccaaugauccuacuaacggcaacugcgacgcuccaaucacagggggaagccccgauccgggugugaaaggcuuugccuuccuggacggggagaauaguuggcuuggaagaaccaucucuaaggauuccaggucaggcuaugaaauguugaaagucccuaacgcagagacggacacccagaguggugcuauuagccaucaaaugauagugaauaaccagaauugguccggguacucuggcgccuuuaucgacuacugggcgaacaaggaauguuucaaucccugcuuuuauguggagcugauucggggacguccaaaagaaagcucaguccuauggacaaguaacuccaucguugcccucuguggcagccgcgagagacuggggucuuggucauggcacgauggagcagagauuaucuacuucaaguga

SEQ ID NO: 146446 - RNA, 1413 nt, Artificial Sequence
  derived and/or modified sequence opt3 from neuraminidase__InfluenzaA__AHJ57876
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacaacuaccaucauaaacaaucauccgcaaaacaauuucacaaacaucaccaauauuaucaugaacaagaaugaagagggcaacuuucugaaccuaacuaaaccccucugugaaguaaauuccuggcacauucugucuaaggauaacgcaaucagaauaggggagaaugcccauauucuugugacaagggaaccuuaucugucgugcgacccacagggaugucggauguucgcguugucacagggcaccacgcuccgcggucgacacgcuaacgggacuauccaugaucguagccccuuuagagcccugauuaguugggagaugggacaggcaccuuccccauacaaugccaggguggagugcaucggcuggucuagcaccuccugucacgacggcaaaucacggaugaguaucugcauuagcgggcccaacaauaacgcuucugcagucgugugguauggaggucgcccuauaacagaaaucccauccugggccggcaauauucugagaacucaagagucagaauguguuugccacgggggaaucuguccgguggucaugaccgauggccccgcuaacaauagggccgagacaaagauaauuuacuucaaggaggguaaagugcagaagaucgaggagcucaaagggaacgcgcagcauaucgaagagugcagcuguuauggagcaaguggcaugauuaagugcaucugccgggacaauuggaaaggcgccaaccgcccuguaauuaccauagauccagaaaugaugacgcacacuucuaaguacuuauguuccaagauccugacagacaccagccgacccaaugauccuacuaacgggaacugcgacgcuccaauuacaggagguucgcccgauccgggcguuaaaggguuugccuuccuugacggagaaaauucuugguugggcagaaccaucuccaaggauucaaggagugguuaugagaugcugaaagugccuaacgcagaaacggacacccagagcggggcuaucucccaucaaauuauagucaauaaccagaauuggucuggcuacagcggagccuuuaucgacuacugggcgaacaaggaguguuucaaucccugcuuuuauguggaacuaauucggggccguccaaaagagucaagugugcucuggacauccaacagcaucgucgcccugugugggucucgcgaaagacuuggaucauggaguuggcacgauggugcagagauuaucuacuucaaguga

SEQ ID NO: 146447 - RNA, 1413 nt, Artificial Sequence
  derived and/or modified sequence opt3 from neuraminidase__InfluenzaA__AHJ57888
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaacaugaaugagaccagcccaacaacuaccaucacaaacaaucauccgcaaaacaauuucaccaacauaacuaauaucauuguguccaagaacgaagaggaaaacuuuuuaaaucugacaaaaccccuaugugagguaaacucuuggcacauccucucgaaggauaaugcaauuagaaucggcgaaaacgcccauauacuggugaccagggagccuuaucuuucaugcgacccacaggggugucggauguucgcgcugagccagggaacgacuuugcgcggccagcacgcuaaugguaccauucaugaucgaagucccuuucgugcccucaucuccugggagauggggcaagcaccuucuccauacaacgccagagucgaaugcauuggauggagcuccacaucaugucacgacggcaucaguaggaugagcaucugcauuucuggccccaauaacaaugcuuccgcagugguuugguaugggggacggccugugacugagauaccaucaugggccgguaacauccugcgcacccaggaaagcgagugugucugccacggcgggauuuguccggugguaaugacagauggacccgcuaauaacagagccgagaccaaaaucauauacuucaaggaaggcaagauucagaaaaucgaggaacugaaggguaaugcgcagcauaucgaggaaugcaguuguuauggggcaucuggaaugauuaaaugcaucugcagggacaacuggaagggcgccaaucggccuguuauuacgauagauccagagaugaugacucacacauccaaauaccucuguagcaagaucuuaaccgacacuucgcgccccaacgauccuacaaauggcaacugcgacgcuccaauuaccgggggaucucccgauccgggugugaagggcuuugccuuccuggacggggagaacuccuggcuuggacgaacgaucucaaaagauaguagaagcggcuaugaaauguugaaggucccuaaugcagagaccgacacacaauccggugcuaucucucaucagaugauugugaacaaucagaacuggagcggguacucaggcgccuuuauagacuacugggcgaauaaagaauguuucaaccccugcuuuuauguggagcugaucaggggacggccaaaggaaaguuccguccuauggacuagcaauucuauuguugcccucuguggcucacgugagcgccuggggaguuggagcuggcacgauggagcagagaucauuuacuucaaauga

SEQ ID NO: 146448 - RNA, 1413 nt, Artificial Sequence
  derived and/or modified sequence opt3 from neuraminidase__InfluenzaA__AHJ57900
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacagcaacuaucauaaacaaucauccgcaaaacaauuucaccaacaucacaaauauuaucgugaacaagaaugaagaggaaaacuuuuucaaccuggccaaaccccuaugugagguaaauuccuggcacauucucucuaaggauaacgcgaucagaauaggcgaaaaugcucauauucuggugaccagggagccuuaucuuucgugcgacccacaggggugucggauguuugcccugucacagggaacuacauugcgcggccagcacgcaaacgguaccauccaugaucgaagccccuuccgugcccucauuaguugggagauggggcaagcuccuuccccauacaaugcaagagucgaaugcaucggauggucuagcacguccugucacgacggcaucucaaggaugaguauuugcauaagcggccccaacaauaacgccucugcugugguuugguaugggggacggccugugacugagaucccauccugggccgguaauauucugcgcacccaggaaucagagugugucugccacggcgggaucuguccggugguaaugacagauggacccgcgaacaauagagcagagacuaaaauaauuuacuuuaaggaaggcaagauccagaaaaucgaggaccugaaggguaacgcccagcauauugaagagugcagcuguuauggggcuaguggaaugaucaaaugcauuugcagggauaauuggaagggcgccaaccggccuguuauaaccaucgacccagaaaugaugacacacaccucuaaauaccucuguuccaagauuuuaacggauacuagccgccccaaugacccuacaaacggcaacugcgaugcaccaaucaccgggggaucgcccgacccgggugugaagggcuucgcuuuucuggauggggaaaauucuuggcuuggacgaacuaucuccaaagacucaagaaguggcuaugagauguugaaggucccuaacgccgagacagacacccaaagcggugcgauuucccaucagaugauagugaauaaccagaauuggucuggguacagcggcgccuucaucgauuacugggcaaacaaagaguguuuuaaucccugcuucuauguggaacugauuaggggacggccaaaggagucaaguguccuauggacguccaacagcaucguugcucucuguggcucucgugaacgccuggggucauggaguuggcacgacggagccgagauuaucuacuuuaaauga

SEQ ID NO: 146449 - RNA, 1413 nt, Artificial Sequence
  derived and/or modified sequence opt3 from neuraminidase__InfluenzaA__AHJ57911
augaaccccaaucagaagauuaccugcaucagcgccacaggcgugacucuguccgucguuucucuccuuauagggaucgcuaaccugggauugaauauugguuuacacuacaaagugucagacaguagcaacaucaauauuccuaacaugaaugagacgaacccaaccacaacuaucauaaauaaccauacccaaaauaacuucaagaauaucacaaacauuaucguaaauaaaaacgaagagggcauuuuucugaaccuaaccaagccgcucugugaagucaauuccuggcacauccugucuaaagauaacgcaauaagaauuggggaggacgcccauauccuugugacuagggaacccuaucugucgugcgauccucagggaugucggauguucgcguugucacagggcacaacccuccgcggucgacacgcuaaugggacgauucaugaccguagcccauuuagagcccugaucaguugggagaugggacaggcacccuccccuuacaacgccaggguggagugcaucggcuggucuagcacuuccugucacgauggcauuucacggaugaguauaugcaucagcgggccaaauaacaaugcuucugcaguugugugguaucgcggaagacccgucaccgaaauuccuuccugggccgguaacauccugaggacacaagagucagaaugugugugccacaagggcauauguccaguaguuaugacugacgggccggcuaauaaccgggccgcgaccaagauuaucuacuucaaagagggaaagauccagaaaauugaggaacucaagggcaaugcacagcauaucgaggaaugcagcuguuauggugccgcugggaugauuaaaugcauaugccgcgauaacuggcgaggagccaauagacccgugaucacaauugacccugagaugaugacccacacgaguaaguacuuauguucuaagauccugacugauacauccaggccaaacgaccccaccaauggcaacugcgaugcaccuaucacuggcgggagcccagaccccggagucaaagguuuugcuuuccuugauggcgaaaacucgugguuggggcggacaauuucuaaggacucccguucaggauaugagaugcugaaagugccgaaugccgagaccgacacgcagaguggcagcaccuccuaccaaauaaucgugaacaaucagaacuggucugguuacagcggggcguuuauugauuauugggccaauaaggaauguuucaacccuugcuuuuacgucgagcuaauccgcggcagacccaaagaaucaaguguucucuggacauccaauagcauuguggcacuguguggaucuagggagcggcuuggcucauggaguuggcaugacggggcugaaaucauauauuucaaguga

SEQ ID NO: 146450 - RNA, 1410 nt, Artificial Sequence
  derived and/or modified sequence opt3 from neuraminidase__InfluenzaA__AHJ57923
augaaccccaaucagaagaucauuaccgugggcagcgucucccuggccauagcuacaaucugcuuccucaugcaaauugcaauccuugccacuacgguuacccugcacuuuaaacagaacgaguguaauauuccuucuaagaaccaggugaugccaugcgaaccgaucauaaucgagagaaauauuacagaaguaguguacuugaacaauacuaucauugagaaagaaaucugucccaaggucguggaguauaggaacuggucaaaaccucagugccaaauaaccggguucgcgccauuuaguaaggacaauagcauucgguuauccgcuggaggugauaucuggguuacacgcgagcccuacgugucuuguucgccuucaaagugcuaucaguucgcccugggccaggggaccacucuagacaacagccauaguaauggaacaauucacgaucgaaucccacaucguacccuccugaugaacgaacuuggcguccccuuucaccuggguacgaaacagguguguaucgcaugguccucuagcuccugccaugacgggagagccugguugcacguauguauuacuggagaugacaggaaugcuaccgcaucauucauauacaacggcaugcucguugauaguaucagcucuuggucccggaauauucugcgcacacaagagucagaaugcguguguaucaacggcacuugcaccgucauaaugacagacgggagcgccaguggaguggcugauacccggauucuguuuaucagggaggguaagaucgugcacgucucuccucucuccggcagcgcccagcauauugaggaaugcucguguuauccacgguacccggacguucgcugcgugugucgagauaacuggaaagggucuaauagacccguaguggacaucaacauggcggauuauuccauugacucacacuacgucugcaguggauuagugggcgacacgccuaggaaugaugacagcuccucuagcucaaacuguaaggauccaaauaacgagcgggguaaucccgggguuaaaggaugggcauucgacgauggcaacgacguguggaugggccguacuauaagucgcgauuccagaagcggguacgaaacauuuagggucaucggagguuggaccacugccaauucuaagucacagauuaacagacaggugaucguagacaauaacaauuggaguggcuauagcgggguuuucuccguggagggaaagucuugcaucaaccgauguuuuuacgucgaacugauucgcggcagaccucaagagacaagggugugguggaccucgaauagcauagucguguucugcgguacguccgggaccuauggcacaggaucauggccagauggcgcuaacaucaacuuuaugcccauuuga

SEQ ID NO: 146451 - RNA, 1380 nt, Artificial Sequence
  derived and/or modified sequence opt3 from neuraminidase__InfluenzaA__AHJ57935
augaaccccaaucagaagaucacuugcauuagcgccacaggcgugacucuguccgucguuucucuccuuauagggaucgcuaaccugggauugaauauugguuuacacuacaaagugucagacaguccuacgaucaacauuccaaauaugaacgagaccaauccgacaacuaccaacaucacaaauauaaucguaaacaagaaugaagagggcaccuuccugaaccuaacuaaaccccucugugaagugaauagcuggcauauucuguccaaggauaacgcaaucagaauuggggaggacgcccacauccuugucacaagggaaccuuaucugucuugcgauccacaaggaugucggauguuugcguugucgcagggcaccacgcuccgcggucgacaugcuaaugggacuauacacgaccguucacccuucagagcccugauuagcugggagaugggacaggcaccuaguccauacaacaccaggguggagugcaucggcugguccucuacaagcugucaugauggcauuucccggaugucaaucugcaucagugggcccaacaauaacgccagcgcuguugugugguaucgcggaagaccugucacugaaauuccaucuugggcagguaauauacugaggacccaggaguccgaaugugugugccacaaaggcaucuguccgguaguuaugacagacgggcccgccaacaauaaggcugccaccaagauuaucuacuuuaaagagggaaagauacagaaaauugaggaacuccaaggcaacgcgcagcacaucgaggaaugcucauguuauggugcagccgggaugaucaagugcgugugccgggauaauuggaaaggagcuaaccgcccuauuaucacgauugacccagagaugaugacucauacaagcaaguacuuauguaguaagauacugaccgauacuucucgacccaaugacccuacaaacggcaauugcgaugccccaaucaccggcgggucccccgacccgggagucaaagguuucgcauuucuugauggcgaaaacagcugguuggggagaacgauuucgaaggacucuagguccggauaugagaugcugaaagugccuaaugcucagaccgacacacaaucaggccccaccaguuaccagcuaaucgugaacaaucagaacuggagcgguuacuccggggccuucaucgauuauugggcgaacaaggaguguuuuaauccaugcuucuacgucgaacucauucggggccguccuaaagagucuaacguucuguggaccagcaauucaaugguggcccuuuguggaagucgcgaaagacugggcuccuggagcuggcacgacgaugcagagauaaucuauuuuaaguga

SEQ ID NO: 146452 - RNA, 1410 nt, Artificial Sequence
  derived and/or modified sequence opt3 from neuraminidase__InfluenzaA__AHJ57946
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaguucgcgcuaggacaaggcaccacgcucgacaacucacacagcaaugguacuauucaugaucgaaucccucaccguacccugcuuaugaacgaacugggggucccauuucauuugggaacaaaacaggugugcauugcuuggaguuccucuagcugucacgacggcagagccuggcuccacaucugcaucacuggcgaugacaggaaugcaaccgccuccuucauuuacgaugggaugcugguagacucaauaggaaguuggagcaagaacauccugcggacacaggagucugaauguguuugcauuaaugguaccugugcuguggucaugacggauggcuccgcaucagggguggccgacacucgcauccucuuuauaagagagggaaagauugugcauaucagccccuuaaguggcucugcucagcacaucgaggaaugcuccugcuauccuagguacccagauguccgguguguuugccgcgacaacuggaaagguagcaaccgaccggugauugauaucaauauggccgacuauucgauugacucucauuacguauguuccgggcuggugggagauacacccagaaacgacgauaauucaaguagcuccaacugcagggacccuaauaacgagcggggcaauccaggcgucaaggggugggcguucgaugacggaaacgauguguggaugggucguaccauaaaucgcgacucuagaagcggcuacgaaacuuuuaggguuaucgggggauggacaaccgcaaacucaaagagucaaauuaaucgacaggugaucgucgauaacaauaacugguccggcuauagcgguguguucucuguagaggggaaaucauguaucaaucggugcuuuuacguugaacuuauucgcggcagaccccaggagccuagggugugguggacgaguaacagcauagucguguucuguggaaccuccggcacauaugggacuggaucuuggccagacggugccaacaucaauuuuaugcccauuuga

SEQ ID NO: 146453 - RNA, 1410 nt, Artificial Sequence
  derived and/or modified sequence opt3 from neuraminidase__InfluenzaA__AHJ57957
augaaccccaaucagaagaucauuaccauaggcagcgugucccugacaaucgccacugucucuuuccucaugcaaauugcuauccuuacgaccacaguuacucugcacuuuaaacagaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaauucgcgcuaggacagggcaccacgcucgacaacucacauagcaaugguacuauucacgaucgaaucccucaucguacccugcuuaugaacgaacugggggucccauuucacuugggaacaaaacaggugugcauugcuuggaguuccucuagcugucaugacggcagagccuggcuccacaucugcaucacuggcgaugacaggaaugcaaccgccuccuucauuuacgaugggaugcugguagacucaauaggaaguuggagcaagaacauccugcggacacaggagucugaauguguuugcauuaaugguaccugugcuguggucaugacggauggcuccgcaucagggguggccgacacucgcauccucuuuauaagagagggaaagauugugcacaucagccccuuaaguggcucugcucaacauaucgaggaaugcuccugcuauccuagguacccagauguccgguguguuugccgcgacaacuggaaagguagcaaccgaccggugauugauaucaauauggccgacuauucgauugacucuaacuacguauguuccgggcuggugggagauacacccagaaaugacgauaacucaaguagcuccaauugcagggacccuaacaaugagcggggcaacccaggcgucaaggggugggcguucgauuacggaaaugacguguggaugggucguaccauaaaccgcgauucuagaagcggcuaugaaacuuuuaggguuaucgggggauggacaaccgcaaauucaaagagucagauuaaccgacaggugaucgucgacaauaacaauugguccggcuacagcgguguguucucuguagaggggaaaucauguaucaaccggugcuuuuauguugaacuuauucgcggcagaccccaggagccuagggugugguggacgaguaacagcauagucguguucuguggaaccuccggcacauacgggacuggaucuuggccagauggugccaauaucaacuuuaugcccauuuga

SEQ ID NO: 146454 - RNA, 1410 nt, Artificial Sequence
  derived and/or modified sequence opt3 from neuraminidase__InfluenzaA__AHJ57968
augaaccccaaucagaagaucauuaccgugggcagcgucucccuggccauagcuacaaucugccuccuuaugcaaauugcaauccuggccacuacgguuaccuugcacuucaaacagaacgaguguaauauuccuucuaagaaccaggugaugccaugcgaaccgaucauaaucgagagaaauauuacagaaguaguguacuuaaacaauacuaucauugagaaagaaaucugucccaaggucguggaguauaggaacuggucaaaaccucagugccaaauaaccggguuugcgccauucaguaaggacaauagcauucggcuguccgcuggaggugauaucuggguuacacgcgagcccuacgugucuuguucgccuucaaagugcuaucaguuugcccuaggccaggggaccacucucgacaacagccauaguaauggaacaauucacgaucgaaucccacaucguacccugcuuaugaacgaacugggcguccccuuccacuuggguacgaaacagguguguaucgcaugguccucuagcuccugccaugacgggagagccuggcuccacguauguauuacuggagaugacaggaaugcuaccgcaucauuuauauacaacggcaugcugguugauaguaucagcucuuggucccggaauauucugcgcacacaagagucagaaugcguguguaucaacggcacuugcaccgucauaaugacagacgggagcgccaguggaguggcugauaccaggauucucuucaucagagaggguaagaucgugcacauuucuccuuuauccggcagcgcccagcauaucgaggaaugcucguguuauccacgguacccggacguccgcugcguuugucgagauaacuggaaagggucuaauagacccgugauugacauaaacauggcggauuauuccaucgacucaaauuacguaugcaguggacuggugggcgacacgccuaggaacgaugacaauagcuccucuagcaacugucgggauccaaauaacgagcgugguaaucccggggucaagggaugggcauuugacgauggcaacgacguguggaugggccgcacuauuaauagagauucaaggaguggguacgaaacauuccggguuaucggagguuggaccacugccaacuccaaaagccagaucaaucgacaggugauugucgacaacaauaacuggucuggcuauucagggguguuuaguguagagggaaagagcugcauaaaccgcuguuucuacguugaacuuaucagaggcaggccucaagagacacgggugugguggaccuccaauucuauugucguguuuugcgguacgucguguaccuaugggacaggcagcuggccagauggagcuaacaucaauuucaugcccauuuga

SEQ ID NO: 146455 - RNA, 1413 nt, Artificial Sequence
  derived and/or modified sequence opt3 from neuraminidase__InfluenzaA__AHJ57980
augaaccccaaucagaagaauaccugcaucagcgccauuggcaugacacuguccguggucucucuccuuauagggguugcugaccugggauugaacaucgguuuacacuacaaagugucagauaguagcaacauuaauaucccuaacaugaaugagacuaacccaacgaccacaauuaucaauaacaauccgcaaaacaauuucacuaacauaaccaauaucauuguaaacaagaacgaagaggaaaaauuucugaaucuaacaaagccccucugugaggugaacuccuggcauauccugucuaaagacaaugcaauuagaaucggcgaagaugcccacauacuugucaccagggagccuuaucugucgugcgacccacaggggugucggauguucgcguugucacagggaacuacacuccgcggccgacaugcuaacgguaccauucacgaucguagccccuuuagagcccugaucaguugggagauggggcaggcaccuuccccauacaaugccaggguggaaugcauuggauggucuagcacguccugucaugacggcaucucacggaugaguaucugcauuagcggccccaacaauaacgcuucugcaguugugugguaugggggacgcccugucacugagauaccauccugggccgguaauauccugagaacccaagaaucagagugugugugccacaagggcauuuguccgguaguuaugacagaugggcccgcuaacaauagggccgcgacuaagaucauauacuucaaagagggaaagauucagaaaaucgaggaacucaagggcaacgcacagcacaucgaagagugcagcuguuauggugccgcugggaugauuaaaugcaucugccgggacaauuggaagggagccaaccgcccugugauuaccauagauccagaaaugaugacacauaccaguaaguacuuauguucuaaaauccugacggacacuucccgacccaaugauccuacaagcggcaacugcgacgcaccaauuaccggcgggucgcccgauccgggagucaaggguuuugcuuuccuugacggcgagaacucuugguuggggagaacuaucuccaaagacucaaggaguggauaugagaugcugaaggugccuaaugccgaaacagauacccagagcggccccaucuccuaccaaacgauugugaacaaucagaacuggucugguuacagcggggcguuuauagacuauugggccaauaaagaguguuucaacccaugcuuuuacgucgaacuaauccggggccguccuaaggagucaaguguucucuggaccuccaauagcauuguggcacuguguggaucucgcgaaagacuuggcucauggaguuggcacgauggggcugagaucauuuauuucaaauga

SEQ ID NO: 146456 - RNA, 1410 nt, Artificial Sequence
  derived and/or modified sequence opt3 from neuraminidase__InfluenzaA__AHJ57992
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaguucgcgcuaggacaaggcaccacgcucgacaacucacacagcaaugguacuauucaugaucgaaucccucaccguacccugcuuaugaacgaacugggggucccauuucauuugggaacaaaacaggugugcauugcuuggaguuccucuagcugucacgacggcagagccuggcuccacaucugcaucacuggcgaugacaggaaugcaaccgccuccuucauuuacgaugggaugcugguagacucaauaggaaguuggagcaagaacauccugcggacacaggagucugaauguguuugcauuaaugguaccugugcuguggucaugacggauggcuccgcaucagggguggccgacacucgcauccucuuuauaagagagggaaagauugugcauaucagccccuuaaguggcucugcucagcacaucgaggaaugcuccugcuauccuagguacccagauguccgguguguuugccgcgacaacuggaaagguagcaaccgaccggugauuaauaucaacauggccgauuauucgauugacucuaauuacguauguuccgggcuggugggagacacacccagaaacgaugacaauucaaguagcuccaacugcagggauccuaauaacgagcggggcaauccaggcgucaaggggugggcguucgacgauggaaacgacguguggaugggucguaccauaaaucgcgauucuagaagcggcuacgaaacuuuuaggguuaucgggggauggacaaccgcaaacucaaagagucaaauuaaucgacaggugaucgucgacaacaauaacugguccggcuauagcgguguguucucuguagaggggaaaucauguaucaaccggugcuuuuacguugaacuuauucgcggcagaccccaggagccuagggugugguggacgaguaauagcauagucguguucuguggaaccuccggcacauaugggacuggaucuuggccagauggugccaacaucaauuuuaugcccauuuga

SEQ ID NO: 146457 - RNA, 1413 nt, Artificial Sequence
  derived and/or modified sequence opt3 from neuraminidase__InfluenzaA__AHJ58004
augaaccccaaucagaagaucacuugcauuagcgccacaggcgugacucuguccgucguuucucuccuuauagggaucgcuaaccugggauugaauauugguuuacacuacaaagugucagacaguagcaacaucaauauuccuaacaugaaugagacgaacccaaccacaacuaucauaaauaaccauacccaaaauaacuucaagaauaucacaaacauuaucguaaauaaaaacgaagagggcaccuuucugaaccuaacuaagccgcucugugaagugaauaguuggcacauucugucuaaagauaacgcaaucagaauaggggaggacgcccauauucuugucacaagggaacccuaucugucgugcgauccucagggaugucggauguucgcguugucacagggcaccacgcuccgcggucgacacgcuaaugggacuauccaugaccguagcccauuuagagcccugauuaguugggagaugggacaggcacccuccccuuacaacgccaggguggagugcaucggcuggucuagcaccuccugucacgauggcaucucacggaugaguauuugcauaagcgggccaaauaacaaugcuucugcaguugugugguaucgcggaagacccgucacagaaaucccuuccugggccgguaacauucugaggacucaagagucagaaugugugugccacaagggcaucuguccaguaguuaugaccgacgggccggcuaauaaccgggccgcgacaaagauaauuuacuucaaagagggaaagauccagaaaaucgaggaacucaagggcaaugcacagcauauugaggaaugcagcuguuauggugccgcugggaugaucaaaugcauuugccgcgauaacuggcgaggagccaauagacccgugauaaccaucgacccugagaugaugacgcacacuuccaaguacuuauguucuaagauucugacagauaccuccaggccaaacgaccccacuaauggcaacugcgaugaaccuaucacaggcgggagcccagaccccggagucaaagguuuugcauuccuugauggcgagaacucgugguuggggcggaccaucucuaaggacucccguucaggauaugagaugcugaaagugccgaaugcugaaacggacacccagaguggcccuacaagcuaccaaauuauagugaacaaucagaacugguccgguuacucuggggccuuuaucgauuauugggcgaauaaggaguguuucaaccccugcuuuuacgucgaacuaauucgcggcagaccaaaagagagcucaguucucuggaccaguaauuccaucguggcccuguguggaagcagggaacggcuuggcucuuggucauggcaugacggggcagagauuaucuauuucaaguga

SEQ ID NO: 146458 - RNA, 1413 nt, Artificial Sequence
  derived and/or modified sequence opt3 from neuraminidase__InfluenzaA__AHJ58016
augaaccccaaucagaagauuaccugcaucagcgccacaggcaugacucuguccguggucucuaugcucauagggaucgcuaaccuuggacugaauauugguuugcacuacaaaguuucagacaguacgaacaucaauauuccuaagaugaacgagaccaauccaacaacuaccaucauaaacaaucauccgcaaaacaauuucacaaacaucaccaauauuaucgugaacaaaaaugaagaggaaaacuuuuuaaaccugacuaagccccuaugugagguaaauagcuggcacauucucuccaaagauaacgcaaucagaauaggcgaaaaugcccauauucuggugacaagggagccuuaucuuucuugcgacccacaggggugucggauguucgcgcugucgcagggaaccacguugcgcggccgacacgcuaacgguacuauccaugaucguucacccuuuagagcccucauuagcugggagauggggcaggcaccuaguccauacaaugccagggucgaaugcaucggaugguccucuaccagcugucacgacggcaucucccggaugucaauuugcauaaguggccccaacaauaacgcuagcgcagugguuugguaugggggacgcccugugacagagaucccaucuugggccgguaauauucugagaacucaagaauccgagugugucugccacggcgggaucuguccggugguaaugaccgauggacccgcuaacaauagggccgagacaaagauaauuuacuucaaggaaggcaaaauccagaagaucgaggaacugaaagguaacgcgcagcauauugaggaaugcucauguuauggggcaagcggaaugaucaagugcauuugccgggacaauuggaaaggcgccaaccgcccuguuauaaccaucgauccagagaugaugacgcacacuucgaaguaccucuguucuaagauuuuaacagacaccucccgacccaaugauccuacuaacggcaacugcgacgcuccaaucacagggggaagccccgauccgggugugaaaggcuuugccuuccuggacgggaagaauaguuggcuuggaagaaccaucucuaaagauuccaggucaggcuaugagauguugaaggucccuaacgcagaaacggacacccagaguggugcuauuagccaucaaauaaucgugaauaaccagaauugguccggguacucuggcgccuuuauugacuacugggcgaacaaagaguguuucaaucccugcuuuuauguggaacugauccggggacguccaaaggagagcucaguccuauggacaaguaacuccauuguugcccucuguggcagccgcgaaagacuggggucuuggucauggcacgauggagcagagaucauauaccuuaaauga

SEQ ID NO: 146459 - RNA, 1413 nt, Artificial Sequence
  derived and/or modified sequence opt3 from neuraminidase__InfluenzaA__AHJ58028
augaaccccaaucagaagaucacuugcauuagcgccacaggcaugacucuguccguggucucuaugcucauagggaucgcuaaccuuggacugaauauugguuugcacuacaaaguuucagacaguacgaacaucaauauuccuaagaugaacgagaccaauccaacaacuaccaucauaaacaaucauccgcaaaacaauuucacaaacaucaccaauauuaucgugaacaaaaaugaagaggaaaacuuuuuaaaccugacuaagccccuaugugagguaaauagcuggcacauucucuccaaagauaacgcagugagaaucggcgaagacgcccauauacuggucacaagggagccuuaucuuucuugcgauccacaggggugucggauguucgcgcugucgcagggaaccacguugcgcggccgacacgcuaaugguacuauucaugaccguucacccuuuagagcccucaucagcugggagauggggcaggcaccuaguccauacaacaccaggguggaaugcauuggaugguccucuacaagcugucacgauggcaucucccggaugucaaucugcauuaguggccccaauaacaaugccagcgcuguugugugguaucgcgggagaccugucacugagauaccaucuugggcaggaaacauccugaggacccaagaauccgagugugugugccacaaggguauuuguccgguaguuaugacagacggccccgccaauaaccgggcugagaccaagaucauauacuucaaagaagggaagauucagaaaaucgaggaacuggagggaaaugcccagcauaucgaagagugcucauguuauggcacggcggguaugauuaagugcaucugccgcgauaacuggcgaggggcaaauagaccugugauuacuauagacccagagaugaugacacacaccagcagguaccucuguaguaaaaucuuaacugauacaucucggcccaacgacccuaccaauggaaacugcgaugccccaauuacgggcggcucccccgacccgggggucaagggauuugcuuuccuggaugguaagaacagcuggcuuggccguaccaucucgaaagacucucgcuccggguaugaaauguugaaggugccuaaugccgagacagacauccagucaggacccaccaguaaccaaauuauagugaauaaccagaauuggagcggcuacuccggugcauuuaucgauuacugggcuaacaaagaauguuucaauccaugcuuuuaugucgagcugauuagagggaggccuaaggaaucuaacguucuauggaccagcaauucaaucguggcccucuguggcagucgggagcgacugggauccuggagcuggcaugacggcgcggagauuaucuacuucaaauga

SEQ ID NO: 146460 - RNA, 1410 nt, Artificial Sequence
  derived and/or modified sequence opt3 from neuraminidase__InfluenzaA__AHJ58040
augaaccccaaucagaagaucauuaccgugggcagcgucucccuggccauagcuacaaucugccuccuuaugcaaauugcaauccuggccacuacgguuaccuugcacuucaaacagaacgaguguaauauuccuucuaagaaccaggugaugccaugcgaaccgaucauaaucgagagaaauauuacagaaguaguguacuuaaacaauacuaucauugagaaagaaaucugucccaaggucguggaguauaggaacuggucaaaaccucagugccaaauaaccggguuugcgccauucaguaaggacaauagcauucggcuguccgcuggaggugauaucuggguuacacgcgagcccuacgugucuuguucgccuucaaagugcuaucaguuugcccuaggccaggggaccacucucgacaacagccauaguaauggaacaauucacgaucgaaucccacaucguacccugcuuaugaacgaacugggcguccccuuccacuuggguacgaaacagguguguaucgcaugguccucuagcuccugccaugacgggagagccuggcuccacguauguauuacuggagaugacaggaaugcuaccgcaucauuuauauacaacggcaugcugguugauaguaucagcucuuggucccggaauauucugcgcacacaagagucagaaugcguguguaucaacggcacuugcaccgucauaaugacagacgggagcgccaguggaguggcugauacccggauucucuucaucagggaggguaagaucgugcacgucucuccuuuauccggcagcgcccagcauauugaggaaugcucguguuauccacgguacccggacguucgcugcgugugucgagauaacuggaaagggucuaauagacccguaguggacaucaacauggcggauuauuccauugacucacacuacgucugcaguggacuggugggcgacacgccuaggaaugaugacagcuccucuagcucaaacuguaaggauccaaauaacgagcgggguaaucccgggguuaaaggaugggcauuugacgauggcaacgacguguggaugggccguacuauaagucgcgauuccagaagcggguacgaaacauucagggucaucggagguuggaccacugccaauucuaagucacagauuaacagacaggugaucguagacaauaacaauuggaguggcuauagcgggguguuuuccguugagggaaagucuugcaucaaccgauguuucuacgucgaacuuauucgcggcagaccucaagagacaagggugugguggaccucgaauagcauagucguguuuugcgguacguccgggaccuauggcacaggaucauggccagauggcgcuaacaucaacuucaugcccauuuga

SEQ ID NO: 146461 - RNA, 1410 nt, Artificial Sequence
  derived and/or modified sequence opt3 from neuraminidase__InfluenzaA__AHJ58052
augaaccccaaucagaagaucauuaccauaggcagcgugucccugacaaucgccacugucucuuuccucaugcaaauugcuauccuuacgaccacaguuacucugcacuuuaaacauaacgagugcaauaugccuccaaagaaccaggugaugucaugugaaccgauuaucauagagagaaauaucaccgaaauuguauacuugaacaauacaaccguggagaaagaaaucugccccaaggucguggaguauaggaacuggaguaaaccucaguguaagauuacuggguucgcaccauuuagcaaggacaauuccauccgguuaucugccggaggugauauauggguuacacgcgagcccuacgugucgugcggccuggggaaauguuaucaguucgcgcuaggacaaggcaccacgcucgacaacucacacagcaaugguacuauucaugaucgaaucccucaccguacccugcuuaugaacgaacugggggucccauuucauuugggaacaaaacaggugugcauugcuuggaguuccucuagcugucacgacggcagagccuggcuccacaucugcaucacuggcgaugacaggaaugcaaccgccuccuucauuuacgaugggaugcugguagacucaauaggaaguuggagcaagaacauccugcggacacaggagucugaauguguuugcauuaaugguaccugugcuguggucaugacggauggcuccgcaucagggguggccgacacucgcauccucuuuauaagagagggaaagauugugcauaucagccccuuaaguggcucugcucagcacaucgaggaaugcuccugcuauccuagguacccagauguccgguguguuugccgcgacaacuggaaagguagcaaccgaccggugauugauaucaauauggccgacuauucgauugacucuaacuacguauguuccgggcuggugggagauacacccagaaaugacgauaacucaaguagcuccaauugcagggacccuaacaaugagcggggcaacccaggcgucaaggggugggcguucgaugacggaaaugauguguggaugggucguaccauaaaccgcgacucuagaagcggcuacgaaacuuuuaggguuaucgggggauggacaaccgcaaauucaaagagucaaauuaaccgacaggugaucgucgauaauaacaauugguccggcuauagcgguguguucucuguagaggggaaaucauguaucaaccggugcuuuuacguugaacuuauucgcggcagaccccaggagccuagggugugguggacgaguaacagcauagucguguucuguggaaccuccggcacauaugggacuggaucuuggccagacggugccaauaucaacuuuaugcccauuuga

SEQ ID NO: 146462 - RNA, 1413 nt, Artificial Sequence
  derived and/or modified sequence opt3 from neuraminidase__InfluenzaA__AHJ58064
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacaacuaccaucauaaacaaucauccgcaaaacaauuucacaaacaucaccaauauuaucgugaacaagaaugaagaggaaaacuuucugaaccuaacuaaaccccucugugagguaaauuccuggcacauucugucuaaggauaacgcaaucagaauaggcgaaaaugcccauauucuugugacaagggagccuuaucugucgugcgacccacaggggugucggauguucgcguugucacagggaaccacgcuccgcggccagcacgcuaacgguacuauccaugaucgaagccccuuucgugcccugauuaguugggagauggggcaagcaccuuccccauacaaugccagagucgaaugcaucggauggucuagcaccuccugucacgacggcaucucaaggaugaguauuugcauaagcggccccaacaauaacgcuucugcagugguuugguaugggggacggccugugacagagaucccauccugggccgguaauauucugcgcacucaggaaucagagugugucugccacggcgggaucuguccggugguaaugaccgauggacccgcuaacaauagagccgagacaaaaauaauuuacuucaaggaaggcaagauccagaaaaucgaggaacucaaggguaacgcgcagcauauugaggaaugcagcuguuauggggcaaguggaaugaucaaaugcauuugcagggacaauuggaagggcgccaaccggccuguuauaaccaucgauccagagaugaugacgcacacuucuaaauacuuauguuccaagauucugacagacaccagccgccccaaugauccuaucaacggcaacugcgacgcuccaaucacugggggaucgcccgauccgggugugaagggcuuugccuuccuugacggggaaaauucuugguugggacgaacaauuuccaaagauucaagaaguggcuaugagaugcugaaggucccuaacgcagagaccgacacgcaaagcggugcuauaucccaucagaugaucgugaauaaccagaauuggucuggguacagcggcgccuuuauugacuacugggcgaacaaagaauguuucaaucccugcuuuuauguggagcuaaucaggggacggccaaaggaaucaaguguccucuggaccuccaacagcauuguugcccuguguggcucucgugagcgccuugggucauggaguuggcacgauggagcagagaucauauacuucaaauga

SEQ ID NO: 146463 - RNA, 1401 nt, Artificial Sequence
  derived and/or modified sequence opt3 from neuraminidase__InfluenzaA__AHJ58075
augaaccccaaucagaagaucauugccauaggcagcgugucccugaccaucgcuauuaucugcuuccuccuucaaauugcaauccugacaacuacgaugaccuugcacuuuagacagaacgaguguucuaauccuucaaacaaucaggucguuccaugcgaaccgauaaucauugagaggaacacagugcauuuaaauaguacuaccaucgaaaaagagauuugucccaagguagccgaauacaaaaacuggagcaagccucagugccaaaucacaggguucgcgccauuuuccaaagacaauucuauacggcugucggcuggaggugauauuugggugacccgcgagcccuaugucucauguagccuaggcaagugcuaccaguucgcccucgggcagggaacuacacugaagaacaaacacaguaauggcaccacgcaugaccgaaucccucaccguacucuucugaugaacgaguugggugugccauuucaucucgggaccaagcagguuuguauugcaugguccucuagcuccugccacgauggaaaagccuggcugcacaucugugugacaggcgacgauaagaaugcuacugcaucaaucauuuaugacggcaugcuggucgauaguauagggagcuggucuaaaaacauccucagaacccaagaauccgagugcguguguauuaauggaacaugcgccguaguuaugaccgacgguucagcuagcggcaaggccgauacgaggaucuuauucauacgggaagggaagauuaucaacaucaguccccugucuggauccgcgcagcauguggaggagugcagcuguuacccucgcuauccagaagucagaugcguguguagggacaacuggaaaggcucgaaucggccggugcuuuacauuaacauggcagauuauucuaucgaguccucauacgucugcagugguuugguuggggacacuccccgcgaugacgacagcuccucuagcucaaauugucgagauccuaacaaugaaagaggagccccaggcgugaagggcugggcuuuugacgaugggaacgacauuuggaugggaaggacaauaaaaagugauucccggagcgguuacgagaccuuccguguagugaauggcuggacuacagccaacucuaagucacagaucaaucgccaggucauuguggacagugauagcugguccggguauucuggaaucuuuucgguugaaggcaaaaacugcaucaauagauguuucuacguggagcugauuaggggucggccccaagagacccgagucugguggacgagcaacuccauaaucguguuuugcgggaccucaggcacauauggaacuggcaguuggccugacggggcaaauauuaacuucaugccaaucuga

SEQ ID NO: 146464 - RNA, 1413 nt, Artificial Sequence
  derived and/or modified sequence opt3 from neuraminidase__InfluenzaA__AHJ58087
augaaccccaaucagaagauuaccugcaucagcgccacaggcaugacucuguccguggucucucuccuuauagggaucgcuaaccugggauugaauauugguuuacacuacaaaguuucagacaguacgaacaucaauauuccuaacaugaaugagaccagcccaacaacuaccaucauaaacaaucauccgcaaaacaauuucacaaacaucaccaauauuaucgugaacaagaaugaagaggaaaacuuucugaaccuaacuaaaccccucugugagguaaauuccuggcacauucugucuaaggauaacgcaaucagaauaggcgaaaaugcccauauucuugugacaagggagccuuaucugucgugcgacccacaggggugucggauguucgcguugucacagggaaccacgcuccgcggccagcacgcuaacgguacuauccaugaucgaagccccuuucgugcccugauuaguugggagauggggcaagcaccuuccccauacaaugccagagucgaaugcaucggauggucuagcaccuccugucacgacggcaucucaaggaugaguauuugcauaagcggccccaacaauaacgcuucugcagugguuugguaugggggacggccugugacagagaucccauccugggccgguaauauucugcgcacucaggaaucagagugugucugccacggcgggaucuguccggugguaaugaccgauggacccgcuaacaauagagccgagacaaaaauaauuuacuucaaggaaggcaagauccagaaaaucgaggaacucaaggguaacgcgcagcauauugaggaaugcagcuguuauggggcaaguggaaugaucaaaugcauuugcagggacaauuggaagggcgccaaccggccuguuauaaccaucgauccagagaugaugacgcacacuucuaaauacuuauguuccaagauucugacagacaccagccgccccaaugauccuaucaacggcaacugcgacgcuccaaucacugggggaucgcccgauccgggugugaagggcuuugccuuccuugacggggauaauucuugguugggacgaacaauuuccaaagacucaagaaguggcuaugagaugcugaaggucccuaacgcagaaaccgacacgcaaagcggugcuauaucccaucagaugaucgugaauaaccagaauuggucuggguacagcggcgccuuuauugauuacugggcgaacaaagaguguuucaaucccugcuuuuauguggaacuaaucaggggacggccaaaggagucaaguguccucuggaccuccaacagcauuguugcccuguguggcucucgugaacgccuugggucauggaguuggcacgacggagcagagaucauauacuucaaauga

SEQ ID NO: 146465 - RNA, 1410 nt, Artificial Sequence
  derived and/or modified sequence opt3 from neuraminidase__InfluenzaA__AHL80721
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaagggguucgagaugauuugggauccaaauggcuggaccggaacggacaacaauuuuuccauaaaacaagacgucgugggcaucaacgaauggucuggguacucggggagcuucguucagcaucccgagcugacuggucuggauuguauucgaccuugcuucuggguggaacucaucagaggcaggccaaaggagaauacaauuuggaccuccgggucaaguaucucuuuuuguggagucaacagcgacacugugggcugguccuggcccgauggugcagaguuaccguucacaauagacaaauga

SEQ ID NO: 146466 - RNA, 1410 nt, Artificial Sequence
  derived and/or modified sequence opt3 from neuraminidase__InfluenzaA__AHL80732
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucaucauugacaaguga

SEQ ID NO: 146467 - RNA, 1410 nt, Artificial Sequence; identical to SEQ ID NO: 138754
  derived and/or modified sequence opt3 from neuraminidase__InfluenzaA__AHL80743

SEQ ID NO: 146468 - RNA, 1410 nt, Artificial Sequence
  derived and/or modified sequence opt3 from neuraminidase__InfluenzaA__AHL80754
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugugugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcggaguuaccguucacaaucgacaaguga

SEQ ID NO: 146469 - RNA, 1410 nt, Artificial Sequence; identical to SEQ ID NO: 138754
  derived and/or modified sequence opt3 from neuraminidase__InfluenzaA__AHL80765

SEQ ID NO: 146470 - RNA, 1410 nt, Artificial Sequence; identical to SEQ ID NO: 138754
  derived and/or modified sequence opt3 from neuraminidase__InfluenzaA__AHL80776

SEQ ID NO: 146471 - RNA, 1410 nt, Artificial Sequence; identical to SEQ ID NO: 138754
  derived and/or modified sequence opt3 from neuraminidase__InfluenzaA__AHL80787

SEQ ID NO: 146472 - RNA, 1410 nt, Artificial Sequence
  derived and/or modified sequence opt3 from neuraminidase__InfluenzaA__AHL80798
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcgaacggcguaaagggguucucuuuuaaauauggaaacggcguguggaucggucggaccaagucaaucaguagccgcaauggguucgagaugauuugggauccaaacggcuggacaggaaccgacaauaacuuuuccgucaaacaagacauagugggcaucaaugaauggucuggguacucggggagcuucguucagcaucccgagcugacgggucuggauuguauucgaccuugcuucuggguggaacucaucagaggcaggccaaaggagaacacuauuuggacauccgggucaaguaucucuuuuuguggagucaauagcgacaccgugggcugguccuggcccgauggugcagaguuaccguucacuauagacaaauga

SEQ ID NO: 146473 - RNA, 1410 nt, Artificial Sequence; identical to SEQ ID NO: 138754
  derived and/or modified sequence opt3 from neuraminidase__InfluenzaA__AHL80809

SEQ ID NO: 146474 - RNA, 1410 nt, Artificial Sequence; identical to SEQ ID NO: 138754
  derived and/or modified sequence opt3 from neuraminidase__InfluenzaA__AHL80820

SEQ ID NO: 146475 - RNA, 1410 nt, Artificial Sequence; identical to SEQ ID NO: 138754
  derived and/or modified sequence opt3 from neuraminidase__InfluenzaA__AHL80831

SEQ ID NO: 146476 - RNA, 1410 nt, Artificial Sequence; identical to SEQ ID NO: 138754
  derived and/or modified sequence opt3 from neuraminidase__InfluenzaA__AHL80842

SEQ ID NO: 146477 - RNA, 1410 nt, Artificial Sequence; identical to SEQ ID NO: 140042
  derived and/or modified sequence opt3 from neuraminidase__InfluenzaA__AHL80853

SEQ ID NO: 146478 - RNA, 1410 nt, Artificial Sequence
  derived and/or modified sequence opt3 from neuraminidase__InfluenzaA__AHL80864
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaaggggaguugcggaccuguguccagcaauggugcgaacggcguaaagggguucucuuuuaaauacggaaacggcguguggaucggucggaccaagucaaucaguagccgcaauggguucgagaugauuugggauccaaacggcuggacaggaaccgacaauaacuuuuccauaaaacaagacaucgucggcauuaaugaauggucuggguauucggggagcuucgugcagcaccccgagcugacgggucuggauuguauccgaccuugcuucuggguugaacucauuagaggcaggccaaaggagaacacuaucuggacauccgggucaaguauaucuuuuuguggagugaauagcgacaccgucggcugguccuggcccgauggugcagaguuaccguucacuaucgacaaauga

SEQ ID NO: 146479 - RNA, 1410 nt, Artificial Sequence; identical to SEQ ID NO: 140042
  derived and/or modified sequence opt3 from neuraminidase__InfluenzaA__AHL80875

SEQ ID NO: 146480 - RNA, 1410 nt, Artificial Sequence; identical to SEQ ID NO: 140042
  derived and/or modified sequence opt3 from neuraminidase__InfluenzaA__AHL80886

SEQ ID NO: 146481 - RNA, 1410 nt, Artificial Sequence
  derived and/or modified sequence opt3 from neuraminidase__InfluenzaA__AHL80897
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcaucaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaaggggaguugcggaccuguuuccagcaauggugcgaacggcgugaagggguucucuuuuaaauauggaaacggcguauggaucggucggaccaagucaauuaguagccgcaauggguucgagaugauaugggauccaaacggcuggacaggaaccgacaauaacuuuuccaucaaacaagacauugugggcaucaaugaauggucuggguacucggggagcuucguccagcaucccgagcugacgggucuggauuguauucgaccuugcuucuggguggaacucaucagaggcaggccaaaggagaacacuauauggacauccgggucaaguaucucuuuuuguggaguuaauagcgacaccgugggcugguccuggcccgauggugcagaguuaccguucacuauugacaaauga

SEQ ID NO: 146482 - RNA, 1410 nt, Artificial Sequence
  derived and/or modified sequence opt3 from neuraminidase__InfluenzaA__AHL80908
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucacgauucaugaaaauaacaccuggguuaaucagacauacgugaacaucagcaauacuaacuucgcugcaggccaguccguagugucugucaaacuggccggaaauucgucauugugcccugugagcggaugggcgauauauaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuucaccgucaugacagauggaccaucugacggccaggcuuccuauaaaaucuuucggauugaaaaggguaaaaucgugaagucaguggagaugaaugcccccaacuacuauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcgaacggcguaaagggguucucuuuuaaauauggaaacggcguguggaucggucggaccaagucaaucaguagccgcaauggguucgagaugauuugggauccaaacggcuggacaggaaccgacaauaacuuuuccauaaaacaagacaucgucggcauuaaugaauggucuggguacucggggagcuucgugcagcaucccgagcugacgggucuggauuguauccgaccuugcuucuggguugaacucauuagaggcaggccaaaggagaacacuaucuggacauccgggucaaguauaucuuuuuguggagugaauagcgacaccgucggcugguccuggcccgauggugcagaguuaccguucacuaucgacaaauga

SEQ ID NO: 146483 - RNA, 1410 nt, Artificial Sequence
  derived and/or modified sequence opt3 from neuraminidase__InfluenzaA__AHL80919
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuacaggcgaggucccaucccccuacaacucacguuuugaaagcguggccuggagugcaucugccugccacgacggcauuaacuggcuuaccauagggaucuccggaccugauaauggugcuguagcaguucugaaguauaacggcauuaucacggacacuauaaagagcuggagaaauaacauuuugaggacccaagagucggagugugccugcgugaaugggucuuguuucacaaucaugacugauggaccauccgacggccaggcuucauacaaaaucuuucggauugaaaaggguaaaaucgucaagaguguggagaugaacgcccccaauuaucauuacgaagagugcagcuguuacccugauuccucugagauuaccugcgugugccgcgacaacuggcacgggagcaauagaccaugggucucauucaaccagaaucucgaauaucagauaggauacaucuguaguggcauuuuuggcgauaacccgaggcccaaugacaaaacaggguccugcggaccuguuagcucuaacggugcgaauggcgugaagggguucucauuuaaguauggaaacggcguauggaucggucggaccaaaaguaucagcucccgcaagggguucgagaugauuugggauccaaacggcuggacgggaacugacaauaacuuuucuauaaaacaagacaucgugggcauuaaugaauggucgggguacagcggauccuucguccagcaucccgagcugacaggucuggauuguauccgaccuugcuucuggguggaacucauuagaggcaggccaaaggagaacaccaucuggacuucagggaguucuauaucauuuuguggaguuaauuccgacacagugggcuggucauggcccgauggugcagaguuaccguucaccaucgacaaauga

SEQ ID NO: 146484 - RNA, 1410 nt, Artificial Sequence; identical to SEQ ID NO: 141534
  derived and/or modified sequence opt3 from neuraminidase__InfluenzaA__AHL80930

SEQ ID NO: 146485 - RNA, 1410 nt, Artificial Sequence; identical to SEQ ID NO: 141534
  derived and/or modified sequence opt3 from neuraminidase__InfluenzaA__AHL80949

SEQ ID NO: 146486 - RNA, 1410 nt, Artificial Sequence
  derived and/or modified sequence opt3 from neuraminidase__InfluenzaA__AHL80961
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacaauuuuuccaucaaacaagacguggucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 146487 - RNA, 1410 nt, Artificial Sequence; identical to SEQ ID NO: 146486
  derived and/or modified sequence opt3 from neuraminidase__InfluenzaA__AHL80972

SEQ ID NO: 146488 - RNA, 1410 nt, Artificial Sequence; identical to SEQ ID NO: 141534
  derived and/or modified sequence opt3 from neuraminidase__InfluenzaA__AHL80983

SEQ ID NO: 146489 - RNA, 1410 nt, Artificial Sequence; identical to SEQ ID NO: 141534
  derived and/or modified sequence opt3 from neuraminidase__InfluenzaA__AHL80992

SEQ ID NO: 146490 - RNA, 1410 nt, Artificial Sequence; identical to SEQ ID NO: 141534
  derived and/or modified sequence opt3 from neuraminidase__InfluenzaA__AHL81004

SEQ ID NO: 146491 - RNA, 1410 nt, Artificial Sequence
  derived and/or modified sequence opt3 from neuraminidase__InfluenzaA__AHL81016
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauucagacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaguaguuaguuggagcaaagagauucugcggacgcaggaaucugagugugugugcauaaacggcacuuguacagucgugaugaccgacggcuccgcuucagggaaggcagauacuaaaauccucuuuauugaggaaggaaagaucgugcauacaagcaccuuaagugguucugcccaacacgucgaggaaugcuccugcuauccccgcuacccuggcguuagaugugugugcagggacaacuggaaggggagcaaucggccaauaguagauauuaacaucaaagaccacucgaucgugucuuccuacgucuguucaggacuggugggcgacacgccgcgcaagaaugauaguagcuccucuagccauugccuugaccccaacaaugaggaaggugggcacggaguuaaaggcugggcuuucgaugacggcaacgauguguggauggggcgaaccauuaaugagacaucaagauugggauaugagacuuuuaaggucaucgaagguuggaguaacccuaaauccaagcugcagauuaauaggcaagugauaguagaccggggcaaccguagcggguacucuggaaucuucucaguugagggcaaaaguuguauuaaucgcugcuuuuauguggaacuaaucagagguaggaaggaggaaaccgagguccucuggacaagcaacuccaucguggucuucugugggacuucuggcaccuacggaacaggcucguggccagauggggccgaccugaaucuuaugcccauuuga

SEQ ID NO: 146492 - RNA, 1410 nt, Artificial Sequence; identical to SEQ ID NO: 141534
  derived and/or modified sequence opt3 from neuraminidase__InfluenzaA__AHL81028

SEQ ID NO: 146493 - RNA, 1410 nt, Artificial Sequence; identical to SEQ ID NO: 141534
  derived and/or modified sequence opt3 from neuraminidase__InfluenzaA__AHL81040

SEQ ID NO: 146494 - RNA, 1410 nt, Artificial Sequence; identical to SEQ ID NO: 141534
  derived and/or modified sequence opt3 from neuraminidase__InfluenzaA__AHL81052

SEQ ID NO: 146495 - RNA, 1410 nt, Artificial Sequence; identical to SEQ ID NO: 146486
  derived and/or modified sequence opt3 from neuraminidase__InfluenzaA__AHL81064

SEQ ID NO: 146496 - RNA, 1410 nt, Artificial Sequence; identical to SEQ ID NO: 146486
  derived and/or modified sequence opt3 from neuraminidase__InfluenzaA__AHL81075

SEQ ID NO: 146497 - RNA, 1410 nt, Artificial Sequence
  derived and/or modified sequence opt3 from neuraminidase__InfluenzaA__AHL81086
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcuguguaagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaggaagagaccgaaguccucuggacaaguaacagcaucguggucuucugugggacuuccggcaccuacggaacaggcucuuggcccgauggggccgaccugaaucuuaugccuauuuga

SEQ ID NO: 146498 - RNA, 1410 nt, Artificial Sequence
  derived and/or modified sequence opt3 from neuraminidase__InfluenzaA__AHL81098
augaaccccaaucagaagaucauuaccauaggcagcgugucccugacaaucucuacuauuugcuucuuuguccaaaucgccauucucaucacgaccguuacacuucacuucaaacaguacgaguuuaacucaccuccaaauaaccaggugaugcugugugaaccgacuauaaucgagagaaauauuaccgaaaucguauauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcauugcuuggagcaguuccucuugucaugacgguaaagccuggcuccacgugugcaucacaggggaugacaagaacgcaaccgccagcuucaucuacaauggaaggcugguagauuccguugugucauggaguaaagagauucugcggacgcaggaaagcgagugugucugcauaaacggcacuuguacaguggugaugaccgacggcucugcuuccgggaaggcagauacuaaaauccucuuuauugaggaaggaaagaucguccauacaucaaccuuaagcgguagugcccaacacguugaggaaugcucuugcuauccucgcuacccaggcgugagauguguaugcagggacaacuggaagggguccaaucggccgauaguggauauuaacaucaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccauuaaugagacaagcagauugggauaugagacuuuuaaggugaucgaagguuggucaaacccaaaaaguaagcugcagauuaauaggcagguaauaguugaccggggcaaccguuccggguacagcggaaucuucucuguggagggcaaaucauguauuaaucgcugcuuuuaugucgaacuaaucagagguaggaaggaggaaaccgaggugcucuggacaaguaacagcaucgucguguucugugggacuuccggcaccuacggaacaggcucuuggcccgauggggccgaccugaaucuuaugccuauuuga

SEQ ID NO: 146499 - RNA, 1410 nt, Artificial Sequence; identical to SEQ ID NO: 142725
  derived and/or modified sequence opt3 from neuraminidase__InfluenzaA__AHL81110

SEQ ID NO: 146500 - RNA, 1410 nt, Artificial Sequence; identical to SEQ ID NO: 142725
  derived and/or modified sequence opt3 from neuraminidase__InfluenzaA__AHL81121

SEQ ID NO: 146501 - RNA, 1410 nt, Artificial Sequence; identical to SEQ ID NO: 141534
  derived and/or modified sequence opt3 from neuraminidase__InfluenzaA__AHL81132

SEQ ID NO: 146502 - RNA, 1410 nt, Artificial Sequence; identical to SEQ ID NO: 141534
  derived and/or modified sequence opt3 from neuraminidase__InfluenzaA__AHL81144

SEQ ID NO: 146503 - RNA, 1410 nt, Artificial Sequence; identical to SEQ ID NO: 141534
  derived and/or modified sequence opt3 from neuraminidase__InfluenzaA__AHL81156

SEQ ID NO: 146504 - RNA, 1410 nt, Artificial Sequence; identical to SEQ ID NO: 143803
  derived and/or modified sequence opt3 from neuraminidase__InfluenzaA__AHL81168

SEQ ID NO: 146505 - RNA, 1410 nt, Artificial Sequence; identical to SEQ ID NO: 143803
  derived and/or modified sequence opt3 from neuraminidase__InfluenzaA__AHL81180

SEQ ID NO: 146506 - RNA, 1410 nt, Artificial Sequence; identical to SEQ ID NO: 141534
  derived and/or modified sequence opt3 from neuraminidase__InfluenzaA__AHL81192

SEQ ID NO: 146507 - RNA, 1410 nt, Artificial Sequence
  derived and/or modified sequence opt3 from neuraminidase__InfluenzaA__AHL81215
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucauguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuauguaucgugcgauccugacaaguguuaccaauucgcgcuaggccaggggacgacucucaauaacgugcauucaaauaacaccguccgagaucguacaccauauagaacucugcuuaugaaugaacugggagugcccuuucacuugggcaccaagcagguuugcauugcuuggagcaguuccucuugucaugacgguaaagccuggcuccacgugugcaucacaggggaugacaagaacgcaaccgccagcuucaucuacaauggaaggcuggucgauuccgugguaucauggaguaaagagauucugcggacgcaggaaagcgaguguguuugcauaaacggcacuuguacaguggucaugaccgacggcucugcuuccgggaaggcagauacuaaaauccucuuuauugaggaaggaaagaucgugcauacaucaaccuuaagcgguagugcccaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccauuaaugagacaagcagauugggauaugagacuuuuaaggugaucgaagguuggucaaacccaaaaaguaagcugcagauuaauaggcaggucauaguggaccggggcaaccguuccggguacagcggaaucuucucuguagagggcaaaucauguauuaaucgcugcuuuuauguugaacuaaucagagguaggaaggaggaaaccgaggugcucuggacaaguaacagcaucgucguguucugugggacuuccggcaccuacggaacaggcucuuggcccgauggggccgaccugaauuucaugccuauuuga

SEQ ID NO: 146508 - RNA, 1410 nt, Artificial Sequence
  derived and/or modified sequence opt3 from neuraminidase__InfluenzaA__AHL81227
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacucauccuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuacaggcgaggucccaucccccuacaacucacguuuugaaagcguggccuggagugcaucugccugccacgacggcauuaacuggcuuaccauagggaucuccggaccugauaauggugcuguagcaguucugaaguauaacggcauuaucacggacacuauaaagagcuggagaaauaacauuuugaggacccaagagucggagugugccugcgugaaugggucuuguuucacaaucaugacugauggaccauccgacggccaggcuucauacaaaaucuuucggauugaaaaggguaaaaucgucaagaguguggagaugaacgcccccaauuaucauuacgaagagugcagcuguuacccugauuccucugagauuaccugcgugugccgcgacaacuggcacgggagcaauagaccaugggucucauucaaccagaaucucgaauaucagauaggauacaucuguaguggcauuuuuggcgauaacccgaggcccaaugacaaaacaggguccugcggaccuguuagcucuaacggugcgaauggcgugaagggguucucauuuaaguauggaaacggcguauggaucggucggaccaaaaguaucagcucccgcaagggguucgagaugauuugggauccaaacggcuggacgggaacugacaauaacuuuucuauaaaacaagacaucauuggcaucaaugaauggucgggguacagcggauccuucgugcagcaucccgagcugacaggucuggauuguauucgaccuugcuucugggucgaacucaucagaggcaggccaaaggagaacaccauauggacuucagggaguucuaucagcuuuuguggagugaauagcgacacaguuggcuggucauggcccgauggugcagaguuaccguucaccauugacaaauga

SEQ ID NO: 146509 - RNA, 1410 nt, Artificial Sequence; identical to SEQ ID NO: 141534
  derived and/or modified sequence opt3 from neuraminidase__InfluenzaA__AHL81238

SEQ ID NO: 146510 - RNA, 1410 nt, Artificial Sequence; identical to SEQ ID NO: 141534
  derived and/or modified sequence opt3 from neuraminidase__InfluenzaA__AHL81250

SEQ ID NO: 146511 - RNA, 1410 nt, Artificial Sequence; identical to SEQ ID NO: 141534
  derived and/or modified sequence opt3 from neuraminidase__InfluenzaA__AHL81262

SEQ ID NO: 146512 - RNA, 1410 nt, Artificial Sequence; identical to SEQ ID NO: 141534
  derived and/or modified sequence opt3 from neuraminidase__InfluenzaA__AHL81274

SEQ ID NO: 146513 - RNA, 1410 nt, Artificial Sequence; identical to SEQ ID NO: 141534
  derived and/or modified sequence opt3 from neuraminidase__InfluenzaA__AHL81286

SEQ ID NO: 146514 - RNA, 1410 nt, Artificial Sequence; identical to SEQ ID NO: 141534
  derived and/or modified sequence opt3 from neuraminidase__InfluenzaA__AHL81298

SEQ ID NO: 146515 - RNA, 1410 nt, Artificial Sequence; identical to SEQ ID NO: 146486
  derived and/or modified sequence opt3 from neuraminidase__InfluenzaA__AHL81310

SEQ ID NO: 146516 - RNA, 1410 nt, Artificial Sequence; identical to SEQ ID NO: 142725
  derived and/or modified sequence opt3 from neuraminidase__InfluenzaA__AHL81332

SEQ ID NO: 146517 - RNA, 1410 nt, Artificial Sequence
  derived and/or modified sequence opt3 from neuraminidase__InfluenzaA__AHL81343
augaaccccaaucagaagaucauuaccauaggcagcgugucccugacaaucucuacuauuugcuuccucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguuugcaccauucagcaaagauaacuccauucggcuaucugccggaggugacaucuggguaacccgcgagcccuaugugucgugcgauccugacaaguguuaccaauuugcgcucggccaggggacgacucugaauaacguccauucaaauaacaccgugcgagaucguacaccauauagaacucuucugaugaaugaauugggaguucccuuccaccucggcaccaaacaggugugcauugcuuggagcaguuccucuugucaugacgguaaggccuggcugcacgucugcaucacaggggaugacaagaacgcaaccgccagcuuuaucuacaauggaaggcugguggauuccguaguuucauggaguaaagagauucuccggacgcaggaaagcgagugugugugcauaaacggcacuuguacagucgugaucaccgacggcucugcuuccgggaaggcagauacuaaaauuuuauucaucgaggaaggaaagauagugcauacaucaacccugagcgguagugcccaacacgucgaggaaugcucuugcuauccucgcuacccaggcguuagaugugugugcagggacaacuggaagggguccaaucggccgauuguagauaucaacaucaaagaccacagcauugugucgucuuacgucuguuccggacuugugggcgacacgccccgcaagaaugauucaaguagcuccucucauugcagcgacccuaacaaugaggaaggugggcacggaguuaaaggcugggcuuuugaugacggcaacgauguguggauggggcgaaccaucucagagaagaguagauugggauaugagacauucaaagucauugaagguugguccaauccaaagagcaaacugcagauaaacaggcaagugaucguagaccggggcaaucguucuggguacucaggaauuuuuaguguugagggcaagagcuguaucaaccgcugcuucuauguggaacuaaucagagguaggaaggaggaaacugagguccucuggaccuccaauucuauuguggucuuuugugggacaucgggcacuuacggaaccggcagcuggcccgauggggccgacauaaaccugaugccuaucuga

SEQ ID NO: 146518 - RNA, 1410 nt, Artificial Sequence; identical to SEQ ID NO: 141534
  derived and/or modified sequence opt3 from neuraminidase__InfluenzaA__AHL81355

SEQ ID NO: 146519 - RNA, 1410 nt, Artificial Sequence; identical to SEQ ID NO: 142725
  derived and/or modified sequence opt3 from neuraminidase__InfluenzaA__AHL81367

SEQ ID NO: 146520 - RNA, 1410 nt, Artificial Sequence; identical to SEQ ID NO: 142725
  derived and/or modified sequence opt3 from neuraminidase__InfluenzaA__AHL81378

SEQ ID NO: 146521 - RNA, 1410 nt, Artificial Sequence; identical to SEQ ID NO: 142725
  derived and/or modified sequence opt3 from neuraminidase__InfluenzaA__AHL81389

SEQ ID NO: 146522 - RNA, 1410 nt, Artificial Sequence; identical to SEQ ID NO: 141534
  derived and/or modified sequence opt3 from neuraminidase__InfluenzaA__AHL81400

SEQ ID NO: 146523 - RNA, 1410 nt, Artificial Sequence; identical to SEQ ID NO: 146507
  derived and/or modified sequence opt3 from neuraminidase__InfluenzaA__AHL81412

SEQ ID NO: 146524 - RNA, 1410 nt, Artificial Sequence; identical to SEQ ID NO: 138754
  derived and/or modified sequence opt3 from neuraminidase__InfluenzaA__AHL81422

SEQ ID NO: 146525 - RNA, 1410 nt, Artificial Sequence; identical to SEQ ID NO: 140042
  derived and/or modified sequence opt3 from neuraminidase__InfluenzaA__AHL81433

SEQ ID NO: 146526 - RNA, 1410 nt, Artificial Sequence
  derived and/or modified sequence opt3 from neuraminidase__InfluenzaA__AHL88954
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauuaaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaauugcgaucaggauacgagacauuuaaggucaucgaggguuggaguaauccaaacuccaaacugcagauuaauagacaggugauaguagacagggauaaccggagcggcuauucugggaucuucucaguugaaggaaagaguuguauuaaucguugcuuuuacguggagcuaauccgcggcagaaaggaagagacugaaguccucuggaccagcaacuccaucguggucuucugugguacaucugggacuuauggcaccggaucguggcccgacggcgccgauauuaaucugaugccuauauga

SEQ ID NO: 146527 - RNA, 1410 nt, Artificial Sequence
  derived and/or modified sequence opt3 from neuraminidase__InfluenzaA__AHL89033
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugaggauaaaaguuguauuaaucguugcuuuuacguggaacuaauccgcggcagaaaggaggaaacugagguccucuggaccagcaacuccaucguggucuucugugguacaucugggacuuauggcaccggaucguggcccgacggcgccgauauuaaucugaugccuauauga

SEQ ID NO: 146528 - RNA, 1410 nt, Artificial Sequence
  derived and/or modified sequence opt3 from neuraminidase__InfluenzaA__AHL89045
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucggcauccaggcguucgcugugugugcagagacaacuggaagggguccaauaggccgauaguagauauuaacaucaaagacuacagcaucgugucgucuuacgucuguuccggacuggugggcgacacgccccggaagaaugauucaaguagcuccucucacugccuugacccuaacaaugaggaaggugggcauggaguuaaaggcugggcuuucgaugacggcaacgauguguggauggggcgcaccauuagcgagaaguugcgaucaggauaugagacauuuaaagucaucgaagguuggaguaauccaaacuccaagcugcagacuaauagacaggugauuguagacaggggcaaccggagcggguacucuggaauauucucaguugagggcaaaaguuguaucaaucguugcuuuuauguggaacuaauucgcgguagaaaggaggaaaccgagguccucuggacaagcaacuccaucguggucuucugugggacuucuggcaccuacggaacaggcucguggcccgauggggccgacaucaaucugaugccuauuuga

SEQ ID NO: 146529 - RNA, 1410 nt, Artificial Sequence
  derived and/or modified sequence opt3 from neuraminidase__InfluenzaA__AHL89057
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaagccaaauuccaaacugcagauuaacagacaggugauaguagacaggggcaaucggagcggguauucuggaaucuucucaguugagggcaagaguuguauuaaccguugcuuuuacguggaacuaauccgcgguagaaaggaggaaacugagguccucuggaccagcaauuccaucguggucuucugugggacaucuggcacuuauggaaccggcucguggcccgauggggccgacauuaaccugaugccuauauga

SEQ ID NO: 146530 - RNA, 1410 nt, Artificial Sequence; identical to SEQ ID NO: 137723
  derived and/or modified sequence opt3 from neuraminidase__InfluenzaA__AHL89069

SEQ ID NO: 146531 - RNA, 1410 nt, Artificial Sequence; identical to SEQ ID NO: 136728
  derived and/or modified sequence opt3 from neuraminidase__InfluenzaA__AHL89081

SEQ ID NO: 146532 - RNA, 1410 nt, Artificial Sequence; identical to SEQ ID NO: 136728
  derived and/or modified sequence opt3 from neuraminidase__InfluenzaA__AHL89093

SEQ ID NO: 146533 - RNA, 1410 nt, Artificial Sequence; identical to SEQ ID NO: 136728
  derived and/or modified sequence opt3 from neuraminidase__InfluenzaA__AHL89117

SEQ ID NO: 146534 - RNA, 1410 nt, Artificial Sequence; identical to SEQ ID NO: 136728
  derived and/or modified sequence opt3 from neuraminidase__InfluenzaA__AHL89129

SEQ ID NO: 146535 - RNA, 1410 nt, Artificial Sequence
  derived and/or modified sequence opt3 from neuraminidase__InfluenzaA__AHL89141
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauccaaacaguaagcuacagacuaauagacaggugauuguagacaggggcaaccgguccggguauagcggaauauucucuguugagggcaaaucauguaucaaucguugcuuuuacguggaacucauucgcgguagaaaggaggaaaccgagguccuguggacaaguaacagcaucguggucuucugugggacuuccggcaccuauggaacaggcucuuggcccgauggggccgacaucaaucuuaugccuauuuga

SEQ ID NO: 146536 - RNA, 1410 nt, Artificial Sequence
  derived and/or modified sequence opt3 from neuraminidase__InfluenzaA__AHL89153
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucucacuaggccaggggacgacucucaacaauguccauagcaacgacaccgugcacgaucgaacaccauaucguacucugcuuaugaaugaacugggaguucccuuucauuugggcaccaaacaggugugcauugcguggaguuccucuagcugucacgacgguaaggcuuggcuccaugucugcgugacaggggaugacaagaacgccaccgcauccuucaucuacaauggaagacugguagauucaaucguuaguuggagcaaagagauucugaggacgcaggaaucugagugugugugcauaaacggcacuuguacagucgugaugaccgacggcuccgccucagggaaggcugauacuaaaauccucuuuauugaggaaggaaagaucgugcacacaagcaccuuaagugguucugcacaacacgucgaggaaugcuccugcuauccucgguacccaggcguucgcugugugugcagagacaacuggaaggggagcaauaggccgauaguagauauuaacaucaaagacuacucgaucgugucuuccuaugucuguucaggacuggugggcgacacgccccggaagaaugauaguagcuccucuagccauugccuugacccuaacaaugaggaaggugggcacggaguuaaaggcugggccuucgaugacggcaacgauguguggauggggcgcaccauuucagagaaguugcgaaguggauacgagacauuuaaagucaucgaagguugguccaauccaaacagcaagcugcagauuaauagacaggugauaguagacaggggcaaccggucuggguauucaggaaucuucaguguugagggcaaaagcuguauuaaucguugcuuuuacguggaacuaauccgcgguagaaaggaggaaacugagguccucuggaccuccaacucuaucguggucuucugugggacaucgggcacuuauggaaccggcagcuggcccgauggggcugacauuaaucugaugccuauauga

SEQ ID NO: 146537 - RNA, 1410 nt, Artificial Sequence; identical to SEQ ID NO: 136728
  derived and/or modified sequence opt3 from neuraminidase__InfluenzaA__AHL89165

SEQ ID NO: 146538 - RNA, 1410 nt, Artificial Sequence
  derived and/or modified sequence opt3 from neuraminidase__InfluenzaA__AHL89177
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaacgagauucugaggacgcaggaaagcgagugugugugcauaaacggcacuuguacagucgugaugaccgacggcucugcuuccgggaaagcagauacuaagauccucuuuauugaggaaggaaaaaucgugcacacaucaaccuuaagcgguagugcccaacacgucgaggaaugcucuugcuauccucgguacccaggcguucgcugugugugcagagacaauuggaagggguccaacaggccgauaguagauauuaauaucaaggacuacagcaucgugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcaaucggagcggguauucuggaaucuucucaguugagggcaagaguuguauuaaccguugcuuuuacguggaacuaauccgcgguagaaaagaggaaaaugagguccucuggacuagcaacuccaucguggucuucugugggaccucuggcacauauggaacuggcucguggcccgauggggccgacauuaaucugaugccuauauga

SEQ ID NO: 146539 - RNA, 1410 nt, Artificial Sequence; identical to SEQ ID NO: 138580
  derived and/or modified sequence opt3 from neuraminidase__InfluenzaA__AHL89189

SEQ ID NO: 146540 - RNA, 1410 nt, Artificial Sequence; identical to SEQ ID NO: 137723
  derived and/or modified sequence opt3 from neuraminidase__InfluenzaA__AHL89201

SEQ ID NO: 146541 - RNA, 1410 nt, Artificial Sequence; identical to SEQ ID NO: 138580
  derived and/or modified sequence opt3 from neuraminidase__InfluenzaA__AHL89213

SEQ ID NO: 146542 - RNA, 1410 nt, Artificial Sequence
  derived and/or modified sequence opt3 from neuraminidase__InfluenzaA__AHL89225
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacaguguaacauaacaggguucgcacccuuuaguaaagacaauagcauucggcuguccgccggaggugauaucuggguaacccgcgagccuuaugugucuugcgacccagauaaguguuaccaauucgcgcuaggccaggggacgacucucaacaauguccauucgaacgacaccgugcacgaucgaacacccuaucguacucugcuuaugaaugaacugggaguuccuuuucauuugggcaccaaacaggugugcauugcuuggucaagcaguuccugucacgacgguaaggccuggcuccaugucugcgugacaggggaugacaagaacgcaaccgccucuuucaucuacaauggaagacugguagauagcaucguuuccuggucaaaagagauucugaggacgcaggaaagugagugugugugcauaaacggcacuuguacagucgugaugaccgacggcagcgcuucugggaaggcagauacuaaaauccucuuuauugaggaaggaaagaucgugcacacauccaccuuaucagguagcgcccaacacgucgaggaaugcaguugcuauccacgguacccgggcguucgcugugugugcagagacaacuggaaggggucuaauaggcccauaguagauauuaacaucaaagacuacuccaucgugagcucguaugucuguucuggacuggugggcgacacgccucggaagaaugauuccucaaguagcucccauugccuugacccaaacaaugaggaaggugggcacggaguuaaaggcugggcuuucgaugacggcaacgauguguggauggggcgcaccauuucugagaaguugcgacugggauacgagacauuuaaagucaucgaagguuggagcaaucccaacucaaagcuacagacuaauagacaggugauuguagacaggggcaaccggaguggguauuccggaauauucagcguugagggcaaaucuuguaucaaucguugcuuuuacguggaacucauucgcgguagaaaggaggaaaccgagguccuguggacaucaaacaguaucguggucuucugugggacuagcggcaccuauggaacaggcuccuggccugauggggccgacaucaaucuuaugccaauuuga

SEQ ID NO: 146543 - RNA, 1410 nt, Artificial Sequence; identical to SEQ ID NO: 138580
  derived and/or modified sequence opt3 from neuraminidase__InfluenzaA__AHL89237

SEQ ID NO: 146544 - RNA, 1410 nt, Artificial Sequence; identical to SEQ ID NO: 137723
  derived and/or modified sequence opt3 from neuraminidase__InfluenzaA__AHL89261

SEQ ID NO: 146545 - RNA, 1410 nt, Artificial Sequence
  derived and/or modified sequence opt3 from neuraminidase__InfluenzaA__AHL89273
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauccaaacaguaagcuacagacuaauagacaggugauuguagacaggggcaaccgguccggguauagcggaauauucucuguugagggcaaaucauguaucaaucguugcuuuuacguggaacucauucgcgguagaaaggaggaaaccgauguccuguggacaaguaacagcaucguggucuucugugggacuuccggcaccuauggaacaggcucuuggcccgacggggccgauaucaaucuuaugccuauuuga

SEQ ID NO: 146546 - RNA, 1410 nt, Artificial Sequence
  derived and/or modified sequence opt3 from neuraminidase__InfluenzaA__AHL89285
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauccaaacaguaagcuacagacuaauagacaggugauuguagacaggggcaaccgguccggguauagcggaauauucucuguugagggcaaaucauguaucaaucguugcuuuuacguggaacucauucgcgguagaaaggaggaaaccgauguccuguggacaaguaacagcaucguggucuucuguuccacuucugggaccuauggcacaggaucguggcccgacggcgccgauaucaaucuuaugccuauuuga

SEQ ID NO: 146547 - RNA, 1410 nt, Artificial Sequence; identical to SEQ ID NO: 146545
  derived and/or modified sequence opt3 from neuraminidase__InfluenzaA__AHL89297

SEQ ID NO: 146548 - RNA, 1410 nt, Artificial Sequence; identical to SEQ ID NO: 146545
  derived and/or modified sequence opt3 from neuraminidase__InfluenzaA__AHL89309

SEQ ID NO: 146549 - RNA, 1410 nt, Artificial Sequence
  derived and/or modified sequence opt3 from neuraminidase__InfluenzaA__AHL89321
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacaucucaacauuaagcgguagugcccaacacguugaagagugcucuugcuauccucgguacccaggcgugcgcuguguaugcagagacaacuggaagggguccaacaggccgauaguggacauuaauaucaaaaacuacagcaucgucucgucuuauguguguuccggacugguuggcgauacgccccggaagaccgacucaaguagcuccucucauugccuugauccuaauaacgaagagggugggcacggagugaaaggcugggcuuucgacgauggcaaugacgucuggauggggcgcaccauuagcgaaaaguugcgacugggauacgagacauuuaaagugaucgaggguuggucaaacccaaauaguaagcuacagauuaacagacagguaauaguugauaggggcaaucgguccggguauagcggaaucuucucuguggaaggcaaaucauguauuaaccguugcuuuuacgucgagcucauccgcgguagaaaggaagagacugaagugcuguggaccaguaauagcaucgucguguucugugggacauccggcacuuauggaaccggcucuuggcccgacggggccgauauuaaccuuaugccuauauga

SEQ ID NO: 146550 - RNA, 1410 nt, Artificial Sequence
  derived and/or modified sequence opt3 from neuraminidase__InfluenzaA__AHL89333
augaaccccaaucagaagaucauuaccauaggcagcgugucccugacaaucucuacuauuugcuucuuuaugcaaaucgccauucucaucgcuacggucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaauuagcagaguacaggaauuggaguaagccucaguguaacauaacuggguucgccccauuuagcaaagacaauuccauucggcugucugcgggaggugauaucuggguaacacgcgagcccuaugugucgugcgacccugauaaguguuaccaauucgcucuaggccaggggaccacgcucaacaauguccauucaaacgacacugugcacgaucgaaccccauaucguacacugcuuaugaaugaacugggaguucccuuucauuugggcacuaaacaggugugcauugccuggagcaguuccucuugucacgacgguaaggcauggcuccaugucugcgugaccggggaugacaagaacgccacagcuagcuucaucuacaauggaagacugguagauuccaucguuucauggaguaaagagauucugaggacccaggaaagcgagugugugugcauaaacggcacgugugcagucgugaugacugacggcucugccuccgggaaggcugauacaaaaauccucuuuauugaggaaggaaagaucgugcacaccucaacuuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacaccccggaagaaugauucaaguagcuccucucauugccuugacccuaacaaugaggaaggugggcacggaguuaaaggcugggcguucgaugacggcaacgauguguggauggggcgcaccauuagcgagaaguugcgacugggauacgagacguuuaaagucaucgaagguuggucaaauccaaacaguaagcuacagaccaauagacaggugauuguagacaggggcaaccgguccggguauagcggaauauucucuguugagggcaaaucauguaucaaucguugcuuuuacguggaacucauucgcgguagaaaggaggaaacagagguccuguggaccaguaacagcaucguggucuucugugggacuuccggcacauauggaacuggcucuuggcccgauggggcagacaucaaucuuaugccuauuuga

SEQ ID NO: 146551 - RNA, 1410 nt, Artificial Sequence; identical to SEQ ID NO: 136728
  derived and/or modified sequence opt3 from neuraminidase__InfluenzaA__AHL89345

SEQ ID NO: 146552 - RNA, 1410 nt, Artificial Sequence; identical to SEQ ID NO: 137722
  derived and/or modified sequence opt3 from neuraminidase__InfluenzaA__AHL89357

SEQ ID NO: 146553 - RNA, 1410 nt, Artificial Sequence; identical to SEQ ID NO: 137723
  derived and/or modified sequence opt3 from neuraminidase__InfluenzaA__AHL89369

SEQ ID NO: 146554 - RNA, 1410 nt, Artificial Sequence
  derived and/or modified sequence opt3 from neuraminidase__InfluenzaA__AHL89381
augaaccccaaucagaagaucauuaccauaggcagcgugucccugacaaucucuacuauuugcuucuuuaugcaaaucgccauucucaucacgaccgucacacuucacuucaaacaguacgaguauaacucaccuccaaauaaccagguuaugcugugugaaccgacuauaaucgagagaaauauuaccgaaaucguguacuugacaaacaccacuauugagaaggaaaucugccccaaauuagcugaguauaggaauuggaguaagccucaguguaacauaacaggguuugcaccauucagcaaagacaauuccauucggcugucugccggaggugauaucuggguaacccgcgagcccuacgugucgugcgacccugauaaguguuaucaauuugcgcuaggccaggggacgacucucaacaauguccauucaaacgacaccgugcacgaucgaacaccauaccguacucugcuuaugaaugaacugggaguucccuuccauuugggcaccaaacaggugugcauugcuuggagcaguuccucuugucacgacgguaaggccuggcuccaugucugcgugacaggggaugacaagaacgcaaccgccagcuuuaucuauaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuucauugaggaaggaaagaucgugcacacaucaaccuuaagcgguagugcccaacacgucgaggaaugcucuugcuacccucgguacccaggcguucgcugugugugcagagacaacuggaagggguccaauaggccgauaguagauauuaacaucaaagacuauagcaucgugucgucuuacgucuguuccggacuggugggcgacacgccccggaagaaugauucaaguagcuccucucauugccuugacccuaacaaugaggaaggugggcacggaguuaaaggcugggcuuuugaugacggcaacgauguguggauggggcgcaccauuagcgagaaguugcgacugggauaugagacauucaaagucaucgaagguuggucaaauccaaacaguaagcuacagacuaauagacaggugauuguagacaggggcaaccgguccggguacagcggaauauuuucuguugagggcaaaucauguaucaaucguugcuucuauguggaacucauucgcgguagaaaggaggaaaccgagguccuguggacaaguaacagcaucguggucuuuugugggacuuccggcaccuacggaacaggcucuuggcccgauggggccgacaucaaucuuaugccuauuuga

SEQ ID NO: 146555 - RNA, 1410 nt, Artificial Sequence; identical to SEQ ID NO: 146545
  derived and/or modified sequence opt3 from neuraminidase__InfluenzaA__AHL89405

SEQ ID NO: 146556 - RNA, 1410 nt, Artificial Sequence
  derived and/or modified sequence opt3 from neuraminidase__InfluenzaA__AHL89417
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacacaucaaccuuaagcgguagugcccaacacguugaagagugcucuugcuauccucgguacccaggcgugcgcuguguaugcagagacaacuggaagggguccaacaggccgaucguggacauagauauuaaaaauuacagcaucgucucgucuuauguguguuccggacugguuggcgacacgccccggaagaccgauucaaguagcuccucucauugccuugacccuaacaaugaagagggugggcacggagugaaaggcugggcuuucgaugacggcaacgaugucuggauggggcgcacaaucagcgaaaaguugcgacugggauacgagacuuuuaaagugauugaggguuggucaaauccaaacaguaagcuacagaucaauagacagguaauuguugacaggggcaaccgguccggguauagcggaauauucucuguggaaggcaaaucauguaucaaucguugcuuuuacgucgagcucauucgcgguagaaaggaagagaccgaagugcuguggacaaguaacagcaucgucguguucugugggacuuccggcaccuauggaacaggcucuuggcccgauggggccgacaucaaucuuaugccuauuuga

SEQ ID NO: 146557 - RNA, 1410 nt, Artificial Sequence; identical to SEQ ID NO: 137723
  derived and/or modified sequence opt3 from neuraminidase__InfluenzaA__AHL89429

SEQ ID NO: 146558 - RNA, 1410 nt, Artificial Sequence; identical to SEQ ID NO: 136728
  derived and/or modified sequence opt3 from neuraminidase__InfluenzaA__AHL89441

SEQ ID NO: 146559 - RNA, 1410 nt, Artificial Sequence; identical to SEQ ID NO: 136728
  derived and/or modified sequence opt3 from neuraminidase__InfluenzaA__AHL89453

SEQ ID NO: 146560 - RNA, 1410 nt, Artificial Sequence
  derived and/or modified sequence opt3 from neuraminidase__InfluenzaA__AHL89465
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacauuaccaucgagaaggaaaaaugccccaaguuagcugaguacaggaauuggaguaaaccucaguguaacauaacuggguucgcaccauuuagcaaggacaauuccauucggcugucugccggaggugauaucuggguaacacgcgagcccuaugugucgugcgacccugaucgauguuaccaauucgcgcuaggccaggggaccacgcucaacaauguccauucaaacgacacugugcacgaucguaccccauauagaacacugcuuaugaaugaacugggaguucccuuucauuugggcacuaaacaggugugcauugcuuggagcaguuccucuugucacgacgguaaggccuggcuccaugucugcgugaccggggaugacaagaacgcaacagccagcuucaucuacaauggaaggcugguagauuccaucguuucauggaguaaagagauucugcggacccaggaaagcgagugugugugcauaaacggcacguguacugucgugaugacagacggcucugcuuccgggaaggcagauaccaaaauccucuuuauugaggaaggaaagaucgugcacacuucaacauuaagcgguagugcccaacacgucgaggaaugcucuugcuauccucgcuacccaggcguuagaugugugugcagggacaacuggaagggguccaaucggccgauaguagauauuaacaucaaagacuacagcaucgugucgucuuaugucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacgauuagcgagaaguugagacugggauacgagaccuuuaaagucaucgaagguuggucaaauccaaacaguaagcuacagacaaaucgccaggugauuguagaccggggcaaccguuccggguauagcggaauauucucuguugagggcaaaucauguaucaaucgcugcuuuuacguggaacucauuagagguaggaaggaggaaacugagguccuguggaccaguaacagcaucguggucuucugugggacauccggcacuuauggaaccggcucuuggcccgauggggccgacaucaaucuuaugccuauuuga

SEQ ID NO: 146561 - RNA, 1410 nt, Artificial Sequence; identical to SEQ ID NO: 146535
  derived and/or modified sequence opt3 from neuraminidase__InfluenzaA__AHL89477

SEQ ID NO: 146562 - RNA, 1410 nt, Artificial Sequence
  derived and/or modified sequence opt3 from neuraminidase__InfluenzaA__AHL89489
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguagcauaacaggguucgcaccauuuuccaaagacaacucuauucggcugucggccggaggugauaucuggguaacccgcgagcccuaugugucaugcgacccugauaaguguuaccaauucgcgcuaggccaggggacgacucucaauaacguccauagcaaugacaccgugcacgaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuuguacagucgugaugaccgacggcuccgcuucagggaaggcagauacuaaaauccucuuuauugaggaaggaaagaucgugcacacaagcaccuuaagugguucugcccaacacgucgaggaaugcuccugcuauccucgguacccaggcguucgcugugugugcagagacaacuggaaggggagcaacaggccgauaguagauauuaauaucaaagacuacucgaucgugucuuccuaugucuguucaggacuggugggcgacacgccccggaagaacgaucgcaguagcuccucucauugccuugacccuaauaacgaggaaggugggcacggaguuaaaggcugggcuuucgaugacggcaaugauguguggauggggcgaaccauuagcgagaagucaagaaguggauacgagacauuuaaagucaucgaagguugguccaacccacauagcaaguugcagauuaauaggcaagugauaguagaccggggcaaccguucuggguauucaggaaucuucaguguugagggcaaaagcuguauuaaucgcugcuuuuacguggaacugaucagagguaggaaggaggaaacugagguccuauggaccuccaacucuaucguggucuucugugggacaucgggcacuuauggaaccggcagcuggcccgauggggccgacauuaaucucaugccuauauga

SEQ ID NO: 146563 - RNA, 1410 nt, Artificial Sequence; identical to SEQ ID NO: 137723
  derived and/or modified sequence opt3 from neuraminidase__InfluenzaA__AHL89501

SEQ ID NO: 146564 - RNA, 1410 nt, Artificial Sequence; identical to SEQ ID NO: 137723
  derived and/or modified sequence opt3 from neuraminidase__InfluenzaA__AHL89513

SEQ ID NO: 146565 - RNA, 1410 nt, Artificial Sequence; identical to SEQ ID NO: 137723
  derived and/or modified sequence opt3 from neuraminidase__InfluenzaA__AHL89525

SEQ ID NO: 146566 - RNA, 1410 nt, Artificial Sequence; identical to SEQ ID NO: 137723
  derived and/or modified sequence opt3 from neuraminidase__InfluenzaA__AHL89537

SEQ ID NO: 146567 - RNA, 1413 nt, Artificial Sequence
  derived and/or modified sequence opt3 from neuraminidase__InfluenzaA__AHL89549
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagcaucuggacuaccagaucggguauauuugcagcggaguguuuggugauaacccuagaccaaaagacggcaaggggucauguaauccggucacuguugauggagccgacggcgugaaagguuucaguuacaaguaugggaacggcguauggaucggaaggacaaaauccaaucggcugcgcaagggcuuugagaugaucugggaccccaacggguggaccgauacugacagcgauuucucugugaagcaagacgucguggcuauuacagauuggucaggauacagugguagcuuuguucagcacccugaacucaccggcuuagacugcauacgaccauguuucuggguggagcuggucagagggcuucccagggaaaauacgaccaucuggacauccggaucuucgauuagcuucugcggcguggauuccgacacugccaacuggucauggccugauggugcagaguugccauuuaccaucgacaaauga

SEQ ID NO: 146568 - RNA, 1413 nt, Artificial Sequence; identical to SEQ ID NO: 138046
  derived and/or modified sequence opt3 from neuraminidase__InfluenzaA__AHL89561

SEQ ID NO: 146569 - RNA, 1413 nt, Artificial Sequence; identical to SEQ ID NO: 138046
  derived and/or modified sequence opt3 from neuraminidase__InfluenzaA__AHL89573

SEQ ID NO: 146570 - RNA, 1413 nt, Artificial Sequence; identical to SEQ ID NO: 138081
  derived and/or modified sequence opt3 from neuraminidase__InfluenzaA__AHL89585

SEQ ID NO: 146571 - RNA, 1413 nt, Artificial Sequence
  derived and/or modified sequence opt3 from neuraminidase__InfluenzaA__AHL89597
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugcgagaccguagcccauauagagcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaguauaacggaauaauuacugaaaccaucaaaagcuggaagaaaaggaucuugcggacacaggagucggagugcguguguguaaauggcucuugcuuuacuauuaugaccgauggucccuccaacggggccgcgucauacaagaucuucaaaauugaaaagggaaagguuacaaaaaguauagagcucaaugcaccuaacuuucacuaugaagaguguagcugcuacccagacaccggcacggugaugugugucugccgcgauaauuggcacggcuccaacagacccugggugucuuucaaucagaaccuggacuaccaggugggguauaucugcagcggagucuuuggugauaauccuaggccaaaggacggcaaagggucauguaacccgaugacuguugauggagccgacggcgugaaggguuucaguuacaaauaugggaauggcguauggauuggacggacaaaguccaacaaacugcgcaagggcuuugagaugaucugggaccccaauggguggaccgauacugacagcgauuucucugugaagcaagacgucguggcuaucacagauuggucaggauacagugguagcuuuguucagcauccugaacucaccggcuuagacugcauucgaccauguuucuggguggagcuggucagagggcuucccagggaaaacacgaccauauggacauccggaucuucgaucagcuucugcggcguggauuccgacacugccaauuggucauggccugauggugcagaguugccauuuaccauugacaaauga

SEQ ID NO: 146572 - RNA, 1413 nt, Artificial Sequence; identical to SEQ ID NO: 138081
  derived and/or modified sequence opt3 from neuraminidase__InfluenzaA__AHL89609

SEQ ID NO: 146573 - RNA, 1413 nt, Artificial Sequence
  derived and/or modified sequence opt3 from neuraminidase__InfluenzaA__AHL89621
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcaucgcaagggcuuugagaugaucugggaccccaacggguggaccgauacugacucugauuucucagugaagcaagacgucguggcuauuacagauuggaguggauacagcgguuccuuuguucagcacccugaacugaccggccucgacugcauacgaccauguuucuggguggaguuagucagagggcugcccagggaaaauacgaccaucuggacaucuggaucgagcauuuccuucugcggcguggauucagacacugccaacuggaguuggccugauggugcagagcuuccauuuaccaucgacaaauga

SEQ ID NO: 146574 - RNA, 1413 nt, Artificial Sequence; identical to SEQ ID NO: 138072
  derived and/or modified sequence opt3 from neuraminidase__InfluenzaA__AHL89633

SEQ ID NO: 146575 - RNA, 1413 nt, Artificial Sequence; identical to SEQ ID NO: 138081
  derived and/or modified sequence opt3 from neuraminidase__InfluenzaA__AHL89645

SEQ ID NO: 146576 - RNA, 1413 nt, Artificial Sequence; identical to SEQ ID NO: 138046
  derived and/or modified sequence opt3 from neuraminidase__InfluenzaA__AHL89657

SEQ ID NO: 146577 - RNA, 1413 nt, Artificial Sequence
  derived and/or modified sequence opt3 from neuraminidase__InfluenzaA__AHL89669
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacgagcugcggaagggcuuugaaaugaucugggaccccaauggguggaccgauacugacagcgauuucucugugaagcaagacgucguggcuaucacagauuggucaggauacagugguagcuuuguucagcauccugagcucaccggcuuagacugcauucgcccauguuucuggguggaacugguccgagggcuucccagagagaacacgaccauauggacauccggaucuucgaucagcuucugcggcguggauuccgacacugccaauuggucauggccugauggugcagaauugccauuuaccauugacaaauga

SEQ ID NO: 146578 - RNA, 1413 nt, Artificial Sequence
  derived and/or modified sequence opt3 from neuraminidase__InfluenzaA__AHL89681
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaauaacaaagaguaucgagcucaaugcaccuaacuuucacuaugaagaguguagcugcuacccagacaccggcacgguuaugugugugugccgggauaauuggcacggcuccaaccgccccugggucucuuucaaucagaaccuggacuaccaggugggguauauuugcagcggaguguuuggugauaauccuagaccaaaagacggcaaggggucauguaacccgaugacugucgauggagccgacggcguuaaagguuucaguuacaaguaugggaauggcguguggaucggaaggacaaaauccaacaagcugcggaagggcuuugagaugaucugggaccccaauggguggaccgauacugacagcgauuucucuguaaaacaagacguggucgcuauuacagauuggucaggauacagugguagcuuugugcagcauccugaacucaccggcuuagacugcauacgcccauguuucuggguugagcuggugcgagggcuucccagagaaaacgccacgaucuggaccuccggaucuucgauuagcuucugcggcgucgauuccgacacagcaaauuggucauggccugauggugcugaguugccauuuacuaucgacaaguga

SEQ ID NO: 146579 - RNA, 1413 nt, Artificial Sequence
  derived and/or modified sequence opt3 from neuraminidase__InfluenzaA__AHL89693
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaagggaauaauuacuggcaccaucaaaagcuggagaaagcagaucuugaggacacaggaaucggagugcguguguaugaacgguucuugcuuuacuauuaugaccgaugggcccuccaauggagccgcgucauacaaaaucuucaagauugagaagggcaaaguaacaaagaguauagaacucaacgcaccuaauuuucacuaugaggaauguagcugcuacccagacaccggcaucguuaugugugugugccgggauaacuggcacggguccaaucgccccugggucucuuucaaccagaaucuggacuaccaaauuggauauaucugcagcgguguguuuggcgauaacccuagaccaaaagacggggagggaucauguaauccggugacggucgauggcgccgacgguguuaagggguucaguuacaaauaugacgauggcguguggaucggaaggacuaaguccaaccggcugcgcaaaggcuuugagaugauuugggaccccaauggguggacaaacaccgauagcgacuucucuguaaagcaggauguggucgcuauaacugacuggucaggauacagugguagcuuugugcagcauccugaacucacaggcuuagauugcauccgaccauguuucuggguugagcuggugagagggcuucccagggaaaauaccacgauuuggaccuccggaucuucgaucagcuucugcggcgucaacuccgacacagccaauuggucauggccugauggugcagaguugccauuuacuauugacaaguga

SEQ ID NO: 146580 - RNA, 1413 nt, Artificial Sequence
  derived and/or modified sequence opt3 from neuraminidase__InfluenzaA__AHL89705
augaaccccaaucagaagaucauuaccauaggcagcaucuccauugccaucgggauuaucucucugaugcuccaaauaggaaacaucauuucaaucugggcuagucacagcauucagaaugguucccagaaccauacaggcaucugcaaucagagaauaauuacuuacgagaacucuacgugggugaaucacaccuaugucucgaucaacaauacaaacguuguggcagggaaagacaagacuucaguaacccuugccggaaauagcagucuguguuccauuucuggcugggcgaucuacacaaaagauaacagcaucaggauugguuccaagggggacguguucgucauacgggaaccuuuuaucucaugcagucauuuggagugucgcaccuucuuuuuaacucaaggagcucugcuaaaugauaaacacagcaacggcacagugaaggaccgaucuccauaucgugcccucauguccugcccgcugggcgaagcacccucaccuuacaauagcaaguucgagaguguugccuggucugcuuccgcaugucaugaugggaugggauggcuuaccauugguaucagcggcccagacaacggggccguggcuguccugaaauauaacggaauaauuacggaaacuaucaagucguggaaaaagagaaucuugaggacccaggagucugagugcguguguguaaauggcuccugcuuuacaauuaugacugauggucccucaaacggggccgcgaguuacaaaaucuucaagauugaaaagggaaaaguuaccaagagcauagagcucaaugcaccuaacuuucacuaugaagaguguuccugcuacccagacacaggcaccgugaugugugucugccgggauaauuggcacggcucuaaccgccccugggugagcuucaaucagaaccuggacuaccagaucggguauauuugcucaggaguguuuggugauaauccuagaccaaaagacggcaaggggaguuguaacccggucacgguugauggagccgacggcgugaaagguuucuccuacaaguaugggaauggcguauggaucggaaggacuaaaagcaaccggcugcgcaagggcuuugagaugaucugggaccccaauggguggacagauaccgacucugauuucucagugaagcaagacgucguggcuauuacugauuggaguggauacagcgguuccuuuguucagcauccugaacucacaggcuuagacugcauacgaccauguuucuggguggagcuggucagagggcuucccagggaaaacaccacgaucuggaccucuggaucgagcauuuccuucugcggcguggauucagacacagccaauuggaguuggccugauggugcagaguugccauuuacuaucgacaaauga

SEQ ID NO: 146581 - RNA, 1413 nt, Artificial Sequence; identical to SEQ ID NO: 138046
  derived and/or modified sequence opt3 from neuraminidase__InfluenzaA__AHL89717

SEQ ID NO: 146582 - RNA, 1413 nt, Artificial Sequence; identical to SEQ ID NO: 138046
  derived and/or modified sequence opt3 from neuraminidase__InfluenzaA__AHL89729

SEQ ID NO: 146583 - RNA, 1413 nt, Artificial Sequence
  derived and/or modified sequence opt3 from neuraminidase__InfluenzaA__AHL89753
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaacgacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucauuuggagugucgcacuuucuuuuuaacacaaggagcucugcuaaaugauaagcacagcaacggcaccgugaaagaccgaucuccauaucgugcccucauguccugcccgcugggcgaagcacccucaccuuacaauagcaaguucgagaguguugccuggucugcuuccgcaugucaugaugggaugggauggcuuacgauugguaucagcggcccagacaacggggccguggcuguccugaaguauaacggaauaauuacugaaaccaucaaaucguggaagaaaagaaucuugaggacacaggagucugagugcguguguguaaauggcuccugcuuuacuauuaugaccgauggucccucaaacggggccgcgaguuacaagaucuucaaaauugaaaagggaaagguuacaaaaagcauagagcucaaugcaccuaacuuucacuaugaagaguguuccugcuacccagacaccggcacggugaugugugucugccgggauaauuggcacggcucuaaccgccccugggugagcuucaaucagaaccuggacuaccagaucggguauauuugcucaggaguguuuggugauaauccuagaccaaaggacggcaaagggaguuguaacccggucacuguugauggagccgacggcgugaaggguuucuccuacaaauaugggaauggcguauggaucggaaggacaaagagcaaccggcugcgcaaaggcuuugagaugaucugggaccccaauggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaacacgaccaucuggacaucuggaucgagcauuuccuucugcggcguggauucagacacugccaauuggaguuggccugauggugcagaguugccauuuaccaucgacaaguga

SEQ ID NO: 146584 - RNA, 1413 nt, Artificial Sequence; identical to SEQ ID NO: 138046
  derived and/or modified sequence opt3 from neuraminidase__InfluenzaA__AHL89765

SEQ ID NO: 146585 - RNA, 1413 nt, Artificial Sequence; identical to SEQ ID NO: 138087
  derived and/or modified sequence opt3 from neuraminidase__InfluenzaA__AHL89777

SEQ ID NO: 146586 - RNA, 1413 nt, Artificial Sequence; identical to SEQ ID NO: 138046
  derived and/or modified sequence opt3 from neuraminidase__InfluenzaA__AHL89789

SEQ ID NO: 146587 - RNA, 1413 nt, Artificial Sequence
  derived and/or modified sequence opt3 from neuraminidase__InfluenzaA__AHL89801
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguagcccuugcgggaaauucaagccuguguaguauuuccggcugggcuaucuacacaaaagauaacucuaucaggauugguagcaagggggacguguucgucauacgggagccuuuuaucuccugcucacauuuggagugucgcaccuucuuuuuaacucaaggagcccugcuaaaugauaaacacaguaacggcacagugaaggaccgaagcccauaucgugcacucaugucuugcccgcugggcgaagcccccuccccuuacaauucaaaguucgagagcguugcuuggagugcaucugccugucaugaugggaugggauggcuuaccauugguaucuccggcccagacaacggggcuguggccguccugaaauauaacggaauaauuacggaaacuaucaagagcuggaaaaagagaaucuugaggacccaggagucggagugcguguguguaaauggcucuugcuuuacaauuaugacugauggucccuccaacggggcggcaucauacaaaaucuucaagauugaaaagggaaaaguuaccaagaguauagagcucaaugccccuaacuuucacuaugaagaguguagcugcuacccagacacaggcaccgugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacgguugauggagcugacggcgugaaagguuucaguuacaaguaugggaauggcguauggaucggaaggacuaaauccaaccggcugcgcaagggcuuugagaugaucugggaccccaauggguggacaaacaccgauagcgacuucucugugaagcaagaugucguggccauuacugacuggucaggauacagugguagcuuuguucagcauccugaacucacaggcuuagauugcauacgaccauguuucuggguggagcuggucagagggcuucccagggaaaauaccacgaucuggaccuccggaucuucgauuagcuucugcggcguggacuccgauacagcaaacuggucauggccugacggugcugaguugccauuuacuaucgauaaauga

SEQ ID NO: 146588 - RNA, 1413 nt, Artificial Sequence
  derived and/or modified sequence opt3 from neuraminidase__InfluenzaA__AHL89813
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacugccgauggagcugacggcguuaaagguuucaguuacaaguaugggaauggcguguggauuggaaggacaaaauccaacaagcugcggaagggcuuugagaugaucugggaccccaauggguggaccgauacugacagcgauuucucuguaaaacaagacguggucgccaucacagauuggucaggauacagugguagcuuugugcagcauccugaacucaccggcuuagacugcauucgcccauguuucuggguugagcuggugcgagggcuucccagagaaaacgcaacgauauggaccuccggaucuucgaucagcuucugcggcgucgauuccgacacagcuaauuggucauggccugauggugccgaguugccauuuacuauugacaaguga

SEQ ID NO: 146589 - RNA, 1413 nt, Artificial Sequence; identical to SEQ ID NO: 138087
  derived and/or modified sequence opt3 from neuraminidase__InfluenzaA__AHL89825

SEQ ID NO: 146590 - RNA, 1413 nt, Artificial Sequence; identical to SEQ ID NO: 138046
  derived and/or modified sequence opt3 from neuraminidase__InfluenzaA__AHL89837

SEQ ID NO: 146591 - RNA, 1413 nt, Artificial Sequence
  derived and/or modified sequence opt3 from neuraminidase__InfluenzaA__AHL89849
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucuacaucaauaacacuaauguuguggcagggaaagacaagaccucgguaacacuugccggaaacucaagccuguguaguauuuccggcugggcgaucuauaccaaagauaauucuaucaggauugguagcaagggggacguguucgucauacgggagccuuuuaucuccugcucacauuuggagugucgcacuuucuuuuuaacacaaggagcucugcuaaacgauaaacacaguaauggcaccgugaaggaccgaagcccauaccgugcccucaugucuugcccgcugggcgaagcacccuccccuuauaacucaaaguucgagagcguugccuggagugcuucugcaugucaugaugggaugggauggcuuacgauugguaucuccggcccagacaauggggccguggcuguccugaaauacaacggaauaauuacugaaaccaucaagagcuggaaaaagagaaucuugaggacacaggagucggagugcguguguguaaacggcucuugcuuuacuauuaugaccgauggucccuccaauggggccgcgucauauaaaaucuucaagauugaaaagggaaugguuacaaaaaguauagagcucaacgcaccuaauuuucacuacgaagaguguagcugcuacccagacaccggcacggugaugugugucugccgggauaacuggcacggcuccaaucgccccugggugucuuucaaccagaaucuggacuaucagaucggguacauuugcagcggaguguuuggugauaacccuagaccaaaggacggcaaagggucauguaauccggucacuguugauggagccgacggcgugaaggguuucaguuauaaauacgggaacggcguauggaucggaaggacaaaguccaaucggcugcgcaaaggcuuugagaugaucugggaccccaacggguggaccaauacugauagcgacuucucugugaagcaagaugucguggcuauuacagacuggucaggauauagugguagcuuuguucagcauccugaacucaccggcuuagauugcauacgaccauguuucuggguggagcuggucagagggcuucccagggaaaacacgaccaucuggacauccggaucuucgauuagcuucugcggcguggacuccgauacugccaauuggucauggccugacggugcagaguugccauuuaccaucgauaaguga

SEQ ID NO: 146592 - RNA, 1410 nt, Artificial Sequence; identical to SEQ ID NO: 138082
  derived and/or modified sequence opt3 from neuraminidase__InfluenzaA__AHL89861

SEQ ID NO: 146593 - RNA, 1410 nt, Artificial Sequence
  derived and/or modified sequence opt3 from neuraminidase__InfluenzaA__AHL89873
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaauggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggauggcgggaaccggagcggauacucuggcaucuucucaguagaggguaagaguuguauuaaucguugcuuuuauguugaacuaauccgcgggagaaaggaggaaaccgaggugcucuggacaagcaacuccaucgucguguucuguggcacuucuggaaccuacggcacagggucguggcccgacggagccgauauuaaucugaugccuauauga

SEQ ID NO: 146594 - RNA, 1410 nt, Artificial Sequence; identical to SEQ ID NO: 138759
  derived and/or modified sequence opt3 from neuraminidase__InfluenzaA__AHL89885

SEQ ID NO: 146595 - RNA, 1410 nt, Artificial Sequence
  derived and/or modified sequence opt3 from neuraminidase__InfluenzaA__AHL89897
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagacuaauaggcaggucauaguggaucggggcaaccguagcggguacucuggaaucuucucaguagagggcaagaguuguauuaaucgcugcuuuuauguugaacuaaucagagguaggaaggaggaaaccgaggugcucuggacaagcaacuccaucgucguguucugugggacuucuggcaccuacggaacaggcucguggcccgacggggccgauauuaaucugaugccuauauga

SEQ ID NO: 146596 - RNA, 1410 nt, Artificial Sequence; identical to SEQ ID NO: 138418
  derived and/or modified sequence opt3 from neuraminidase__InfluenzaA__AHL89909

SEQ ID NO: 146597 - RNA, 1410 nt, Artificial Sequence; identical to SEQ ID NO: 138057
  derived and/or modified sequence opt3 from neuraminidase__InfluenzaA__AHL89921

SEQ ID NO: 146598 - RNA, 1410 nt, Artificial Sequence; identical to SEQ ID NO: 138418
  derived and/or modified sequence opt3 from neuraminidase__InfluenzaA__AHL89933

SEQ ID NO: 146599 - RNA, 1410 nt, Artificial Sequence; identical to SEQ ID NO: 138057
  derived and/or modified sequence opt3 from neuraminidase__InfluenzaA__AHL89945

SEQ ID NO: 146600 - RNA, 1410 nt, Artificial Sequence
  derived and/or modified sequence opt3 from neuraminidase__InfluenzaA__AHL89957
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucaaggagggaaagauagugcauacaucaaccuuaagcgguagugcccaacacguggaagagugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgaaaaaucaagauugggauaugagacauuuaaggugauugaggguuggaguaacccaaaauccaagcugcagauaaauaggcaggucaucguggaucggggcaaccguagcggguacucuggaauuuucucaguagaaggcaagaguuguaucaaucgcugcuuuuauguugagcuaaucagagguaggaaagaagagacugaagugcucuggaccagcaacuccauugucguguucugugggacaucuggcacuuacggaaccggcucguggcccgacggggccgauauaaaucugaugccuaucuga

SEQ ID NO: 146601 - RNA, 1410 nt, Artificial Sequence; identical to SEQ ID NO: 137900
  derived and/or modified sequence opt3 from neuraminidase__InfluenzaA__AHL89969

SEQ ID NO: 146602 - RNA, 1410 nt, Artificial Sequence; identical to SEQ ID NO: 137900
  derived and/or modified sequence opt3 from neuraminidase__InfluenzaA__AHL89981

SEQ ID NO: 146603 - RNA, 1410 nt, Artificial Sequence
  derived and/or modified sequence opt3 from neuraminidase__InfluenzaA__AHL89993
augaaccccaaucagaagaucauuaccauaggcagcgugucccugucuaucucaacaauuugcuucuuuaugcaaaucgccauucucaucacuacggucacccuucacuucaaacaguacgaguuuaacaguccuccaaauaaccagguuaugcugugugaaccgacaauaaucgagagaaauauuacugaaaucguguauuugaccaacacaaccauugagaaggaaaucugccccaaauuagcugaguacaggaauuggagcaagccucagugugacauaacuggguucgcaccauuuuccaaagauaacucuauucggcugucggccggaggugacaucuggguaacacgcgagcccuaugugucaugcgauccugacaaguguuaccaauucgcgcuaggccaggggaccacgcucaauaacguccauagcaaugauacugugcgagaccguaccccauauagaacacugcuuaugaacgaacugggaguucccuuucacuugggcacuaaacaggugugcauugcuuggaguuccucuagcugucaugaugguaaggccuggcuccacgucugcaucaccggggacgauaagaaugcaacagccuccuucaucuacaacggaaggcugguggacucaauuguaaguuggagcaaagagauacugcggacccaggaaucugaguguguuugcaucaauggcacguguacucucgugaugacagauggcuccgcuucagggaaggcagacaccaaaauuuuauuuaucgaggaaggaaagauaguccauacuagcacacugagugguucugcccaacacguggaggaaugcuccugcuauccucgcuacccaggcgugagaugugucugcagggauaacuggaaggggagcaaccggccgauuguugacaucaauaucaaagaccacucgauugugucuuccuacguauguucaggacuugugggcgauacccccaggaagaacgacaguagcuccucuagccauugcuuggauccuaauaacgaggaaggugggcacggagucaaaggcugggcuuucgacgauggcaaugacguguggauggggcgaacgaucucagagaagaguagacugggauaugagaccuuuaaaguuauugaagguugguccaacccaaagagcaaacuacagauaaaucgccaggugaucgucgaucggggcaaccguucuggguacucaggaauuuucaguguggagggcaagagcuguaucaaucgcugcuuuuauguagaacucaucagagguaggaaggaggaaacagagguucuguggacuuccaacucuauuguggucuucugugggaccucgggcacauacggaacuggcagcuggcccgacggggccgauauaaaucuuaugccuaucuga

SEQ ID NO: 146604 - RNA, 1410 nt, Artificial Sequence
  derived and/or modified sequence opt3 from neuraminidase__InfluenzaA__AHL90005
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucaagagaaacauuaccgagaucguguauuugacaaauaccacuauugaaaaagagaucugccccaaguuagcugaauacaggaacuggagcaaaccucagugugacauaacaggguucgcaccauuuuccaaggauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugagcugggaguucccuuucauuugggcaccaaacaggugugcauugcuuggaguuccucuagcugucacgaugguaaggccuggcuccaugucugcgugacaggggacgauaaaaacgcaaccgccuccuucaucuacaauggaagacugguagacucaaucguuaguuggagcaaggaaauucugaggacgcaggagucugaaugugugugcauaaacggcacuuguacagucgugaugaccgauggcuccgcuucagggaaagcagacacuaagauccucuuuauugaggagggaaagaucgugcacacaagcaccuuaagugguucugcccaacacgucgaagagugcuccugcuauccucgguacccaggcguucgcugugugugcagagauaauuggaaagggagcaacaggccgauaguagacauuaacaucaaggacuacucgaucgugucucgguaugucuguuccggacuggugggcgauacgccccgcaaaaaugacucauacaguagcucccauugccuugauccuaacaaugaagagggugggcacggaguuaagggcugggcuuucgacgauggcaacgacguguggauggggcgaaccauuucugagaaaagcagaucaggauaugaaacauuuaaggucaucgaggguuggaguaauccaaacuccaaauugcagauuaauaggcaagugauaguagaucggggcaaccguagcggguacucuggaaucuucucaguugaaggcaagaguuguauuaaucgcugcuuuuauguggagcugaucagagguaggaaggaagagacugaaguccuauggaccagcaacuccaucguggucuucugugggacaucuggcacuuacggaaccggcucguggcccgacggggccgauauuaaucucaugccuauauga

SEQ ID NO: 146605 - RNA, 1410 nt, Artificial Sequence; identical to SEQ ID NO: 138106
  derived and/or modified sequence opt3 from neuraminidase__InfluenzaA__AHL90017

SEQ ID NO: 146606 - RNA, 1410 nt, Artificial Sequence; identical to SEQ ID NO: 138057
  derived and/or modified sequence opt3 from neuraminidase__InfluenzaA__AHL90029

SEQ ID NO: 146607 - RNA, 1410 nt, Artificial Sequence; identical to SEQ ID NO: 138073
  derived and/or modified sequence opt3 from neuraminidase__InfluenzaA__AHL90041

SEQ ID NO: 146608 - RNA, 1410 nt, Artificial Sequence; identical to SEQ ID NO: 138073
  derived and/or modified sequence opt3 from neuraminidase__InfluenzaA__AHL90053

SEQ ID NO: 146609 - RNA, 1410 nt, Artificial Sequence; identical to SEQ ID NO: 144338
  derived and/or modified sequence opt3 from neuraminidase__InfluenzaA__AHL90065

SEQ ID NO: 146610 - RNA, 1410 nt, Artificial Sequence; identical to SEQ ID NO: 146600
  derived and/or modified sequence opt3 from neuraminidase__InfluenzaA__AHL90077

SEQ ID NO: 146611 - RNA, 1410 nt, Artificial Sequence; identical to SEQ ID NO: 138082
  derived and/or modified sequence opt3 from neuraminidase__InfluenzaA__AHL90089

SEQ ID NO: 146612 - RNA, 1410 nt, Artificial Sequence; identical to SEQ ID NO: 138759
  derived and/or modified sequence opt3 from neuraminidase__InfluenzaA__AHL90101

SEQ ID NO: 146613 - RNA, 1410 nt, Artificial Sequence; identical to SEQ ID NO: 138057
  derived and/or modified sequence opt3 from neuraminidase__InfluenzaA__AHL90113

SEQ ID NO: 146614 - RNA, 1413 nt, Artificial Sequence; identical to SEQ ID NO: 138648
  derived and/or modified sequence opt3 from neuraminidase__InfluenzaA__AHL90125

SEQ ID NO: 146615 - RNA, 1413 nt, Artificial Sequence
  derived and/or modified sequence opt3 from neuraminidase__InfluenzaA__AHL90136
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacuccggcaugguuaugugugugugcagggauaacuggcauggcucuaaucggcccugggucagcuucaaccagaaucuggacuaucaaaucggguacauuugcucaggaguguuuggugauaacccucgcccagaggacggcgaagggaguuguaauccggugaccgucgauggagccaacggcguuaaagguuucuccuauaaguacgggaauggcguguggaucggaagaacgaaaagcaacaggcugcggaagggcuuugagaugaucugggaccccaauggguggacuaacacagacucugauuucucaguaaaacaggacguggucgcuauuaccgauuggaguggauauagcgguuccuuugugcagcacccugaacucacuggcuuagacugcauacgcccauguuucuggguugagcuggugcgagggcuucccagagaaaacacaaccaucuggacgucuggaucgagcauuuccuucugcggcgucaauucagauaccgccaacuggaguuggccugacggugcagaguugccauuuacaaucgauaaguga

SEQ ID NO: 146616 - RNA, 1413 nt, Artificial Sequence; identical to SEQ ID NO: 138648
  derived and/or modified sequence opt3 from neuraminidase__InfluenzaA__AHL90160

SEQ ID NO: 146617 - RNA, 1413 nt, Artificial Sequence
  derived and/or modified sequence opt3 from neuraminidase__InfluenzaA__AHL90172
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggaauuguaacccggugacggucgauggagccaauggcguuaaagguuucucauacaaguaugggaacggcguguggaucggaagaacuaaaaguaauaggcugcggaagggcuuugagaugauuugggaccccaacggguggacaaacaccgacuccgauuucagcguaaaacaggacguggucgcuauaacugauuggucuggauacucagguaguuuugugcagcacccugaacucacaggcuuagacugcauccgcccauguuucuggguugagcuggugcgagggcuucccagagaaaauaccacgauuuggaccagcggauccucuaucucguucugcggcgucaacagcgauacagccaauugguccuggccugacggugcagaguugccauuuacuauugauaaguga

SEQ ID NO: 146618 - RNA, 1413 nt, Artificial Sequence; identical to SEQ ID NO: 138648
  derived and/or modified sequence opt3 from neuraminidase__InfluenzaA__AHL90184

SEQ ID NO: 146619 - RNA, 1413 nt, Artificial Sequence; identical to SEQ ID NO: 141946
  derived and/or modified sequence opt3 from neuraminidase__InfluenzaA__AHL90196

SEQ ID NO: 146620 - RNA, 1413 nt, Artificial Sequence; identical to SEQ ID NO: 138648
  derived and/or modified sequence opt3 from neuraminidase__InfluenzaA__AHL90220

SEQ ID NO: 146621 - RNA, 1413 nt, Artificial Sequence
  derived and/or modified sequence opt3 from neuraminidase__InfluenzaA__AHL90232
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucaacggagccaauggcguuaaagguuucaguuacaaguaugauaacgggguguggaucggcagaacuaaauccaauaggcugcggaagggauuugagaugauuugggaccccaacggcuggacaaacaccgacagcgauuucucuguaaaacaggacguggucgcuauaacugauuggucaggguacagugguagcuuugugcagcacccugaacucacaggauuagacugcauccgcccauguuucuggguugagcuggugcgaggccuucccagagaaaauaccacgauuuggaccuccgggucuucgaucagcuucugcggagucaacuccgauacagccaauuggucauggccugacggcgcagaguugccauuuacuauugauaaguga

SEQ ID NO: 146622 - RNA, 1413 nt, Artificial Sequence
  derived and/or modified sequence opt3 from neuraminidase__InfluenzaA__AHL90244
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccgaugacgguggauggagccaacggcgucaaagguuucaguuacaaguaugacaaugggguuuggaucggcagaacuaaauccaacaggcugcggaagggauuugagaugauuugggaccccaauggcuggacaaacaccgauagcgacuucucugugaaacaggauguaguggcuauaacugacuggucaggguacaguggauccuuuguccagcacccugaacucacagguuuagauugcauccgcccauguuucuggguggagcugguucgaggccuucccagagaaaacaccacgauuuggaccuccgggucuucgaucagcuucugcggagugaauagcgacacagccucauggaguuggccugauggcgcagaguugccauuuacuauugacaaguga

SEQ ID NO: 146623 - RNA, 1413 nt, Artificial Sequence; identical to SEQ ID NO: 139477
  derived and/or modified sequence opt3 from neuraminidase__InfluenzaA__AHL90256

SEQ ID NO: 146624 - RNA, 1413 nt, Artificial Sequence
  derived and/or modified sequence opt3 from neuraminidase__InfluenzaA__AHL90268
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccuccaucguuaugugugugugcagggauaacuggcacggcucuaaucggcccugggucagcuucaaccagaaucuggacuaccaaauuggcuauaucugcucagggguguuuggagauaacccucgcccagaggacggugaaggcaguuguaauccggugacggucgauggggccaacggaguuaaaggcuucuccuacaaguaugacaaugguguguggaucgggagaacuaaaagcaacaggcugcggaagggcuuugagaugauuugggaccccaauggauggacaaacaccgaucgcgacuucucuguaaaacaggauguggucgcuauaacugacuggucaggcuacagugggagcuuugugcagcacccugaacucacaggauuagauugcauccgaccauguuucuggguugagcuggugagaggucuucccagggaaaacaccacgauuuggaccuccgggucuucgaucagcuucugcggcgucaauuccgacacagccaacuggucauggccugauggagcagaguugccauuuacuauugacaaguga

SEQ ID NO: 146625 - RNA, 1413 nt, Artificial Sequence; identical to SEQ ID NO: 139477
  derived and/or modified sequence opt3 from neuraminidase__InfluenzaA__AHL90280

SEQ ID NO: 146626 - RNA, 1413 nt, Artificial Sequence
  derived and/or modified sequence opt3 from neuraminidase__InfluenzaA__AHL90304
augaaccccaaucagaagaucauuaccauaggcagcaucuccauugccaucgggauuaucucucugaugcuccaaauaggaaacaucauuucaaucugggcuagucacagcauucagacagguucccagaauaacacugagaucugcaaucagagaauaauuacguacgaaaacucuaccugggugaaucauacauaugucaacaucaauaacacuaauguuguggcaggcgaggacaaaaccucgguaacacuugccgggaacucaagccuguguaguauuuccggaugggcgaucuacaccaaggauaauucuaucaggauuggcagcaaaggugacguguucgucauacgggaaccuuuuaucuccugcucacacuuggagugucgcacuuucuuuuuaacacaaggggcucugcuaaacgauaagcauaguaauggaaccgugaaagaccgaagcccauaucgugcccucaugucuugcccgcugggcgaagcacccuccccuuacaacucaaaguucgagagcguugccuggagugcuucugcaugucacgauggcaugggguggcuuacgauuggaaucuccgguccagacaacggcgccguggcuguccugaaguauaaugggauaauuacuggaaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuucauuaugaggaguguagcugcuacccagacaccggaaucguuaugugugugugcagggauaacuggcacggcuccaaucggcccugggucucuuucaaccagaaucuggacuaccaaauuggcuauaucugcagcgggguguuuggagauaacccucgcccagaagacggugagggcucauguaauccggugacggucgauggggccaacggaguuaaaggcuucaguuacaaguaugacaaugguguguggaucgggagaacuaaauccaacaggcugcggaagggcuuugaaaugauuugggaccccaauggauggacaaacaccgauagcgacuucucuguaaaacaggauguggucgcuauaacugacuggucaggcuacagugggagcuuugugcagcacccugagcucacaggauuagauugcauccgcccauguuucuggguugaacuggugcgaggucuucccagagagaacaccacgauuuggaccuccgggucuucgaucagcuucugcggcgucaauuccgacacagccaacuggucauggccugauggagcagaguugccauuuacuauugacaaguga

SEQ ID NO: 146627 - RNA, 1413 nt, Artificial Sequence; identical to SEQ ID NO: 138648
  derived and/or modified sequence opt3 from neuraminidase__InfluenzaA__AHL90316

SEQ ID NO: 146628 - RNA, 1413 nt, Artificial Sequence
  derived and/or modified sequence opt3 from neuraminidase__InfluenzaA__AHL90328
augaaccccaauaagaaaaucauuaccauaggcagcaucuccauugccaucgggauuaucucucugaugcuccagauaggaaacaucauuucaaucugggcuagucacagcauucaaacagguucccagaauaacacuggcaucugcaaucagagaauaauuacguacgagaacucuaccugggugaaucauacauaugucaacaucaauaacacuaauguuguggcaggggaagacaagaccucgguaacacuugccggaaacucaagccuguguaguauuuccggcugggcgaucuacaccaaagauaauucuaucaggauugguagcaagggggacguguucgucauacgggagccuuuuaucuccugcucacacuuggaaugucgcacuuucuuuuuaacacagggagcucugcuaaacgauaaacauaguaauggcaccgugaaggaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaauauaauggaauaauuacuggcaccaucaagagcuggaaaaagcaaaucuugagaacacaggagucggagugcguguguaugaacgguucuugcuuuacuauuaugaccgaugggcccuccaauaaagccgcgucauacaagaucuucaagauugaaaaaggaaagguaacaaaaaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccagauuggguauaucugcagcggaguguuuggugauaacccucgcccagaggacggcgaagggucauguaauccggugacggucgauggagccaacggcguuaaggguuucaguuacaaauaugacaaugggguguggaucggcagaacuaaguccaacaggcugcggaaaggauuugagaugauuugggaccccaauggcuggacaaacaccgauagcgacuucucuguaaagcaagauguggucgcugugacugacuggucaggguacaguggauccuuuguucagcacccugaacucacagguuuagauugcauacgcccauguuucuggguggagcugguccgaggccuucccagagaaaacaccacgaucuggaccuccgggucuucgauuagcuucugcggagugaauagcgacacagccaacuggucauggccugauggcgcagaguugccauuuacuaucgacaaguga

SEQ ID NO: 146629 - RNA, 1413 nt, Artificial Sequence; identical to SEQ ID NO: 138648
  derived and/or modified sequence opt3 from neuraminidase__InfluenzaA__AHL90340

SEQ ID NO: 146630 - RNA, 1413 nt, Artificial Sequence
  derived and/or modified sequence opt3 from neuraminidase__InfluenzaA__AHL90352
augaaccccaaucagaagaucaugaccauuggcagcauauccaucgccauugggaucauuucucugaugcuccaaaucggaaacauaaucucaauuugggcuagucacagcauccagacagguucccagaauaacacuggcauuugcaaucagagaaucauaacguacgagaacucuaccugggugaaucauacauaugucaacauuaauaacacuaauguuguggcaggggaagacaaaaccucgguaacacuugccggaaacucaagccuguguaguaucuccggcugggcgauuuacaccaaggauaauucuaucaggaucgguagcaaaggggacguguucgucauucgggagccuuuuauauccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgaucgguauuuccggcccagacaacggggccguggcuguccugaaguauaauggaaucauaacuggcaccauuaaaagcuggaagaaacagaucuugagaacacaggagucggagugcguguguaugaacgguucuugcuuuacuaucaugaccgaugggcccuccaauaaggccgcgucauacaaaauuuucaagaucgaaaagggaaaaguaacaaagaguauugagcucaacgcaccuaauuuucauuaugaagaguguagcugcuacccagacaccggcauaguuaugugugugugcagggauaacuggcacggcuccaaucggcccugggucucuuucaaccagaaucuggacuaccaaaucggguauauuugcagcggaguguuuggugauaacccucgcccagaggacggcgaagggucauguaguccggugacggucgauggagccaauggcguuaaagguuucuccuacaaguaugacaacgggguguggaucggcagaacuaaaagcaauaggcugcggaagggauuugagaugaucugggaccccaacggcuggacaaauaccgauucugacuucucaguaaaacaggauguggucgcuauuacugacuggaguggguacagcggauccuuugugcagcacccugaacucacagguuuagauugcauacgcccauguuucuggguugagcuggugcgaggcaugcccagagaaaacaccacgaucuggaccucugggucgagcauuuccuucugcggagucaacucagacacagccaauuggaguuggccugauggcgcagagcuuccauuuacuaucgacaaguga

SEQ ID NO: 146631 - RNA, 1413 nt, Artificial Sequence; identical to SEQ ID NO: 145477
  derived and/or modified sequence opt3 from neuraminidase__InfluenzaA__AHL90364

SEQ ID NO: 146632 - RNA, 1413 nt, Artificial Sequence; identical to SEQ ID NO: 139477
  derived and/or modified sequence opt3 from neuraminidase__InfluenzaA__AHL90376

SEQ ID NO: 146633 - RNA, 1410 nt, Artificial Sequence
  derived and/or modified sequence opt3 from neuraminidase__InfluenzaA__AHL90388
augaaccccaaucagaagaucauuaccauaggcagcgugucccugaucauuucuacaaucugcuucuuuaugcaaauugccauccucauaacuacggucacccuucacuucaaacaguacgaguuuaacucaaguccuaauaaccagguuaugcugugugaaccaacaaucauugagagaaauaucacugaaauuguguauuugaccaacacaaucauagagaaggaaauuugcccgaaauuagcugaguacaggaauuggagcaagccccagugugacaucaccggguucgcaccuuuuuccaaagauaacucuauucggcugucggccggaggugacaucuggguaacucgcgagccauaugugucaugcgaucccgacaaguguuaccaauucgcgcuaggccaggggacaacccucaauaacguccauagcaauaacacggugcgagaucguacuccuuauagaacccugcuuaugaaugaacugggaguuccauuucacuugggcacaaaacaggugugcaucgcuuggaguuccucuagcugucaugacgguaaggccuggcuccacgucugcauuacuggggaugacaagaacgcaaccgccuccuucauauacaauggaaggcugguggauucaaucguaaguuggagcaaagagauucugcggacacaggaaucugaguguguuugcaucaacggcaccuguacgguggucaugacugacggcuccgcuucagggaaggcagauacaaaaauacucuuuauugaggaaggaaagaucgugcauaccagcacuuuaagugguucugcccaacacguggaggaaugcuccugcuauccccgcuacccuggcgucagauguguuugcagggacaacuggaaggggagcaaucggccaaucguggauauuaacaucaaagaccacucgauuguaucuuccuacguguguucaggacuggucggcgacacaccgcgcaagaaugauaguagcuccucuagccauugccuugaccccaacaaugaggaaggugggcacggagugaaaggcugggcuuucgaugacggcaacgauguuuggauggggcgaaccauaucagagaagaguagauugggauaugagacguuuaaagugaucgaagguugguccaauccuaagagcaaacugcagauuaacaggcaggucaucguggaccggggcaaucguucuggguacucaggaaucuucaguguagagggcaagagcuguauuaaccgcugcuuuuauguugaacuaauaagagguaggaaggaggaaaccgaggugcucuggacauccaauucuaucgucguguucugugggacuucgggcaccuacggaacaggcagcuggccagauggggccgacauuaaccugaugcccaucuga

SEQ ID NO: 146634 - RNA, 1410 nt, Artificial Sequence; identical to SEQ ID NO: 138528
  derived and/or modified sequence opt3 from neuraminidase__InfluenzaA__AHL90400

SEQ ID NO: 146635 - RNA, 1410 nt, Artificial Sequence; identical to SEQ ID NO: 138528
  derived and/or modified sequence opt3 from neuraminidase__InfluenzaA__AHL90413

SEQ ID NO: 146636 - RNA, 1410 nt, Artificial Sequence
  derived and/or modified sequence opt3 from neuraminidase__InfluenzaA__AHL90425
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcacgaccgaacuccauaucguacccugcuuaugaacgaacugggaguucccuuucauuugggcacaaaacaggugugcaucgcuuggagcaguuccucuugucacgaugguaaggccuggcuccaugucugcauuaccggggacgauaagaaugcaacggccagcuucaucuacaacggaagacugguggacuccaucguaucauggaguaaagagauucugaggacucaggaaagcgaguguguuugcauaaauggcacauguaccguggucaugacugauggcucugcuuccgggaaggcagacacaaaaauccucuuuauugaggaaggaaagaucgugcacaccucaacguuaagcgguagugcccaacacguggaggaaugcucuugcuauccucgguacccaggcguccgcuguguuugcagagauaacuggaagggguccaacaggccgauaguggacauuaauaucaaagaccauagcaucguaucgucuuacguguguuccggacuggucggcgauacaccccggaagaacgacucaaguagcuccucucacugccuugauccuaauaacgaggaaggugggcauggagugaaaggcugggcuuucgacgauggcaaugacguuuggauggggcgcaccauuagcgagaagucacgauugggauaugagacuuuuaaagugaucgaagguuggaguaacccaaaguccaaacugcagauuaauagacaggucauaguggauaggggcgaccggagcggguacucuggaaucuucucaguagagggcaagaguuguauuaaccguugcuuuuauguugaacuaauccgcgguagaaaggaggaaaccgaggugcucuggacaagcaauuccaucgucguguucugugggacuucuggcaccuacggaacaggcucguggcccgauggggccgacauuaaccugaugccuauauga

SEQ ID NO: 146637 - RNA, 1410 nt, Artificial Sequence; identical to SEQ ID NO: 138615
  derived and/or modified sequence opt3 from neuraminidase__InfluenzaA__AHL90437

SEQ ID NO: 146638 - RNA, 1410 nt, Artificial Sequence; identical to SEQ ID NO: 138528
  derived and/or modified sequence opt3 from neuraminidase__InfluenzaA__AHL90449

SEQ ID NO: 146639 - RNA, 1410 nt, Artificial Sequence; identical to SEQ ID NO: 138528
  derived and/or modified sequence opt3 from neuraminidase__InfluenzaA__AHL90461

SEQ ID NO: 146640 - RNA, 1410 nt, Artificial Sequence; identical to SEQ ID NO: 138528
  derived and/or modified sequence opt3 from neuraminidase__InfluenzaA__AHL90473

SEQ ID NO: 146641 - RNA, 1410 nt, Artificial Sequence; identical to SEQ ID NO: 138528
  derived and/or modified sequence opt3 from neuraminidase__InfluenzaA__AHL90485

SEQ ID NO: 146642 - RNA, 1410 nt, Artificial Sequence; identical to SEQ ID NO: 138619
  derived and/or modified sequence opt3 from neuraminidase__InfluenzaA__AHL90497

SEQ ID NO: 146643 - RNA, 1410 nt, Artificial Sequence; identical to SEQ ID NO: 138619
  derived and/or modified sequence opt3 from neuraminidase__InfluenzaA__AHL90509

SEQ ID NO: 146644 - RNA, 1410 nt, Artificial Sequence
  derived and/or modified sequence opt3 from neuraminidase__InfluenzaA__AHL90521
augaaccccaaucagaagaucauuaccauaggcagcgugucccugacaaucucuacuauuugcuucuuucuccaaaucgccauucuuaucacgaccgucacacugcacuucaaacaguacgaguuuaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguucgcaccauuuagcaaagauaacuccauucggcuaucugccggaggugacaucuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcauugcuuggagcaguuccucuugucaugacgguaaggccuggcugcacgucugcaucacaggggaugacaagaacgcaaccgccagcuucaucuacaauggaaggcugguggauuccauuguaucauggaguaaagagauacuccggacgcaggaaagcgaguguguuugcaucaacggcacuuguacaguggucaugaccgacggcucugcuuccgggaaggcagauacuaaaauuuuauuuaucgaggaaggaaagauagugcauacaucaacccugagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuugucggcgacacgccccgcaagaaugauucaaguagcuccucucauugcuuggacccuaacaaugaggaaggugggcacggagugaaaggcugggcuuucgaugacggcaacgauguuuggauggggcgaaccaucagcgagaagucaagacugggauaugagacauuuaaagugauugaagguuggaguaauccaaaguccaaacuacagauaaacaggcaggucaucguggaccggggcaaucguagcggguacucuggaauuuucucaguagagggcaagaguuguaucaaccgcugcuuuuauguugaacucaucagagguaggaaggaggaaacugaggugcuguggaccagcaauuccauugucguguucugugggacaucuggcacuuacggaaccggcucguggcccgauggggccgacauaaaccuuaugccuaucuga

SEQ ID NO: 146645 - RNA, 1410 nt, Artificial Sequence
  derived and/or modified sequence opt3 from neuraminidase__InfluenzaA__AHL90533
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaauggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggagcggggcgaucguagcggguacucuggaaucuucucaguagaaggcaagaguuguauuaaccgcugcuuuuauguugagcuaaucagagguaggaaggaagagaccgaggugcucuggacaagcaauuccaucgucguguucugugggacuucuggcaccuacggaacaggcucguggcccgacggggccgauauuaaccugaugccuauauga

SEQ ID NO: 146646 - RNA, 1410 nt, Artificial Sequence; identical to SEQ ID NO: 138528
  derived and/or modified sequence opt3 from neuraminidase__InfluenzaA__AHL90545

SEQ ID NO: 146647 - RNA, 1410 nt, Artificial Sequence; identical to SEQ ID NO: 138615
  derived and/or modified sequence opt3 from neuraminidase__InfluenzaA__AHL90557

SEQ ID NO: 146648 - RNA, 1410 nt, Artificial Sequence
  derived and/or modified sequence opt3 from neuraminidase__InfluenzaA__AHL90569
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaaaaggguucgcaccauuuagcaaggauaacuccauucggcugucugccggaggugacaucuggguaacacgcgagcccuaugugucgugcgauccugacaaguguuaccaauucgcgcuaggccaggggaccacgcucaauaacguccauucaaauaacacugugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcacguguacugucgugaugacagacggcucugcuuccgggaaagcagauaccaagauccucuuuauugaggaaggaaagaucgugcauacuucaacauuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaauccaaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggcccgauggggccgacauuaaccugaugccuauauga

SEQ ID NO: 146649 - RNA, 1410 nt, Artificial Sequence; identical to SEQ ID NO: 138615
  derived and/or modified sequence opt3 from neuraminidase__InfluenzaA__AHL90581

SEQ ID NO: 146650 - RNA, 1410 nt, Artificial Sequence; identical to SEQ ID NO: 138619
  derived and/or modified sequence opt3 from neuraminidase__InfluenzaA__AHL90593

SEQ ID NO: 146651 - RNA, 1410 nt, Artificial Sequence
  derived and/or modified sequence opt3 from neuraminidase__InfluenzaA__AHL90605
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccaacauuaaucugaugccuauauga

SEQ ID NO: 146652 - RNA, 1410 nt, Artificial Sequence; identical to SEQ ID NO: 138615
  derived and/or modified sequence opt3 from neuraminidase__InfluenzaA__AHL90629

SEQ ID NO: 146653 - RNA, 1410 nt, Artificial Sequence; identical to SEQ ID NO: 138615
  derived and/or modified sequence opt3 from neuraminidase__InfluenzaA__AHL90641

SEQ ID NO: 146654 - RNA, 1410 nt, Artificial Sequence; identical to SEQ ID NO: 138528
  derived and/or modified sequence opt3 from neuraminidase__InfluenzaA__AHL90653

SEQ ID NO: 146655 - RNA, 1410 nt, Artificial Sequence; identical to SEQ ID NO: 138615
  derived and/or modified sequence opt3 from neuraminidase__InfluenzaA__AHL90665

SEQ ID NO: 146656 - RNA, 1410 nt, Artificial Sequence
  derived and/or modified sequence opt3 from neuraminidase__InfluenzaA__AHL90677
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaaacugguggauuccaucguaucauggaguaaggagauucugaggacucaggaaagcgaguguguuugcauaaacggcacauguaccguggucaugacugacggcucugcuuccgggaaagcagauacaaagauccucuuuauugaggaaggaaagaucgugcauaccucaacguuaagcgguagugcccaacacguggaggaaugcucuugcuauccucgguacccaggcguccgcuguguuugcagagacaacuggaaaggguccaauaggccgauaguggauauuaacaucaaggaccacagcaucguaucgucuuacguguguuccggacuggucggcgacacaccccggaaaaaugauucaaguagcuccucucauugccuugacccuaacaaugaggaaggugggcacggagugaagggcugggcuuucgaugacggcaacgauguuuggauggggcgcaccauuagcgagaaaucacgauugggauaugagacuuuuaaggugaucgaagguuggaguaauccaaaauccaagcugcagauuaacagacaggucauaguggacaggggcaaucggagcggguacucuggaaucuucucaguagagggcaagaguuguauuaaccguugcuuuuauguugaacuaauccgcgguagaaaagaggaaaccgaggugcucuggacaagcaauuccaucgucguguucugugggacuucuggcaccuacggaacaggcucguggcccgauggggccgacauuaaccugaugccuauauga

SEQ ID NO: 146657 - RNA, 1410 nt, Artificial Sequence; identical to SEQ ID NO: 138615
  derived and/or modified sequence opt3 from neuraminidase__InfluenzaA__AHL90689

SEQ ID NO: 146658 - RNA, 1410 nt, Artificial Sequence
  derived and/or modified sequence opt3 from neuraminidase__InfluenzaA__AHL90701
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggagguggcaucuggguaacccgcgagcccuaugugucgugcgacccugauaaguguuaccaauucgcgcuagggcagggaacgacucucaauaacguccauucaaauaacaccgugcgagaccguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagauauucugcggacgcaggagagcgaaugugugugcauaaacggcacuuguacagucgugaugaccgacgggucugcuuccggaaaggcagauacuaaaauccucuuuauugaggaggguaagaucgugcauacaucaaccuuaagcggcagugcccaacacgucgaagagugcucuugcuauccucgcuacccagggguuagaugugugugcagggacaacuggaagggauccaaucggccgauaguagauauuaacaucaaagaccacagcaucgugucgucuuacgucuguuccggccuggugggugacacgccccgcaagaaugauucaaguagcuccucucauugccuugacccuaacaaugaagaagggggacacggcguuaaaggcugggcuuucgaugacgggaacgauguguggaugggacgaaccauuagcgagaagucaagauuggguuaugagacauuuaaagucaucgagggcuggaguaauccaaaguccaaacugcagauuaacaggcaagugauaguagaccgggggaaucguagcggauacucuggcaucuucucaguugaagguaagaguuguauuaaccgcugcuuuuauguggagcuaaucagagggaggaaggaagagacugaaguccucuggaccagcaauuccaucguggucuucuguggcacaucuggaacuuacggcaccgggucguggcccgauggagccgacauuaaccugaugccuauauga

SEQ ID NO: 146659 - RNA, 1410 nt, Artificial Sequence; identical to SEQ ID NO: 141320
  derived and/or modified sequence opt3 from neuraminidase__InfluenzaA__AHL90713

SEQ ID NO: 146660 - RNA, 1413 nt, Artificial Sequence; identical to SEQ ID NO: 141953
  derived and/or modified sequence opt3 from neuraminidase__InfluenzaA__AHL90725

SEQ ID NO: 146661 - RNA, 1413 nt, Artificial Sequence; identical to SEQ ID NO: 140946
  derived and/or modified sequence opt3 from neuraminidase__InfluenzaA__AHL90749

SEQ ID NO: 146662 - RNA, 1413 nt, Artificial Sequence; identical to SEQ ID NO: 139477
  derived and/or modified sequence opt3 from neuraminidase__InfluenzaA__AHL90761

SEQ ID NO: 146663 - RNA, 1413 nt, Artificial Sequence
  derived and/or modified sequence opt3 from neuraminidase__InfluenzaA__AHL90773
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgaugacacuugccggaaacucaagccuguguaguauuuccggcugggcgaucuacaccaaggauaauucuaucaggauugguagcaaaggggacguauucgugauacgggagccuuuuaucuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgauugguaucuccggcccagacaacggggccguugcugugcugaaguauaauggaauaauuacuggcaccaucaaaagcuggaagaaacagaucuugagaacacaggagucggagugcgucuguaugaacgguucuugcuuuacuauuaugaccgaugggcccuccaauaaggccgcgucauacaaaaucuucaagauugaaaagggaaaagugacaaagaguauagagcucaacgcaccuaauuuuuauuacgaagaguguagcugcuacccagacaccggcaucguaauguguguuugcagggauaacuggcauggcuccaaucggcccugggugucuuucaaccagaaucuggacuaucaaauuggguacaucugcagcggagucuuuggugauaacccucgcccagaggacagagaaggcucauguaauccggugacgguggauggggccaacggagucaaaggcuucaguuauaaguacgguaaugggguuuggaucggcaggacuaaauccaaccggcugcgcaagggauuugagaugauuugggaccccaauggcuggacaaacaccgacagcgauuucucugugaaacaggacguaguggcuauaacugauuggucaggguauaguggauccuuuguccagcacccugaacucacagguuuagacugcauccgaccauguuucuggguggagcugguuagaggccuucccagggaaaacaccacgauuuggaccuccgggucuucgaucagcuucugcggagugaauagcgauacagccaacuggucauggccugacggcgcagaguugccauuuacuauugauaaguga

SEQ ID NO: 146664 - RNA, 1413 nt, Artificial Sequence
  derived and/or modified sequence opt3 from neuraminidase__InfluenzaA__AHL90785
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucaacggagccgauggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacauuaccaucuggacguccggaucuucgauuagcuucugcggcgucaauuccgauaccgccaacuggucauggccugacggugcagaguugccauuuacaaucgauaaguga

SEQ ID NO: 146665 - RNA, 1413 nt, Artificial Sequence
  derived and/or modified sequence opt3 from neuraminidase__InfluenzaA__AHL90797
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaauaaaagaauaauuacguacgagaacucuaccugggugaaucauacauaugucaacaucaauaacacuaauguuguggcaggggaagacaagaccucgguaacacuugccggaaacucaagccuguguaguauuuccggcugggcgaucuacaccaaagauaauucuaucaggauugguagcaagggggacguguucgucauacgggagccuuuuaucgcuugcucccacuuggaaugucgcacuuucuuuuuaacacagggagcccugcuaaacgauaaacauucaaauggcaccgugaaggaccgaaguccauaucgugcacucaugagcugcccgcugggcgaggcccccucuccuuacaacuccaaguucgaaucaguugcuuggagcgcaagugccugucacgaugggaugggauggcuuacgauugguaucucuggcccagacaacggggcuguggccguccugaaauauaauggaauaauuacuggcaccaucaaguccuggaaaaagcaaaucuugagaacacaggagagcgagugcguguguaugaacgguucgugcuuuacuauuaugaccgaugggcccucugacaaagcggcauccuacaagaucuucaagauugaaaaaggaaagguaacaaaaucaauagagcucaaugccccuaacuuucauuaugaagaguguaguugcuacccagauaccggcaucguuaugugugugugcagggacaauuggcacggcagcaaccggcccugggucuccuucaaucagaaccuggauuaccagauuggguauaucugcucuggaguguuuggugacaauccucgcccagaggauggcgaagggagcuguucaccggugacggucgacggagcuaacggcguuaaggguuucaguuacaaauaugacaaugggguguggaucggcagaacuaaguccaacaggcugcggaaaggauuugagguaauuugggaucccaauggcuggacaaacaccgacagcgauuucucugugaagcaagacgucguggccauaacugauuggucaggguacagugguagcuuuguucagcacccugaacucacaggauuagacugcauccgcccauguuucuggguggagcugguccgaggccuucccagagaaaauaccacgauuuggaccuccgggucuucgaucagcuucugcggagugaacuccgauacagcaaacuggucauggccugacggcgcugaguugccauuuacuauugauaaguga

SEQ ID NO: 146666 - RNA, 1413 nt, Artificial Sequence; identical to SEQ ID NO: 139477
  derived and/or modified sequence opt3 from neuraminidase__InfluenzaA__AHL90809

SEQ ID NO: 146667 - RNA, 1413 nt, Artificial Sequence; identical to SEQ ID NO: 141953
  derived and/or modified sequence opt3 from neuraminidase__InfluenzaA__AHL90821

SEQ ID NO: 146668 - RNA, 1413 nt, Artificial Sequence
  derived and/or modified sequence opt3 from neuraminidase__InfluenzaA__AHL90833
augaaccccaaucagagaaucauuaccauaggcagcaucuccauugccaucgggauuaucucucugaugcuccaaauaggaaacaucauuucaaucugggcuagucacagcauucagacagguucccagaauaacacuggcaucugcaaucagaggauaauuacguacgagaacucuaccugggugaaucauacauaugugaacaucaauaacacuaauguuguggcaggggaagacaagaccucgguaacacuugccggaaacucaagccuguguaguauuuccggcugggcgaucuacaccaaagauaauucuauccggauugguagcaagggggacguguucgucauacgcgagccuuuuaucuccugcucacacuuggaaugucgaacuuucuuuuuaacacaaggagcucugcuaaacgauaaacauaguaauggcaccgccaaggaccguagcccauauagagcacucaugucuugcccgcugggcgaggcccccuccccuuacaacucaaaauucgaaagcguggcuuggagugcaucugccugucacgaugggaugggauggcuuacgauugguaucuccggcccagacaacggggcuguugccgugcugaaguauaauggaauaauuacuggcaccaucaagagcuggaaaaagcagaucuugaggacacaggagucggagugcgucuguaugaacgguucuugcuuuacuauuaugaccgaugggcccuccaauaaagcggcaucauacaagaucuucaaaauugaaaagggaaaggugacaaaaaguauagagcucaacgccccuaauuuuuauuacgaagaguguagcugcuacccagacaccggcaucguaauguguguuugccgggauaacuggcauggcuccaaucgccccugggugucuuucaaccagaaucuggacuaucaaaugggguacauuugcagcggagucuuuggugauaacccuagaccagaggacggcgaagggucauguaauccggugacgguggauggagcuaacggcgucaaggguuucaguuauaaauacgggaauggcguuuggaucggaaggacuaaguccaaccggcugcgcaaaggcuuugagaugaucugggaccccaauggguggacaaacaccgacagcgauuucucugugaagcaggacguaguggccauuacugauuggucaggauauagugguagcuuuguccagcacccugaacucacaggcuuagacugcauacgaccauguuucuggguggagcugguuagagggcuucccagggaaaacaccacgaucuggaccuccggaucuucgauuagcuucugcggcgucaauuccgauacagcaaacuggucauggccugacggugcugaguugccauuuacuaucgauaaauga

SEQ ID NO: 146669 - RNA, 1413 nt, Artificial Sequence; identical to SEQ ID NO: 139477
  derived and/or modified sequence opt3 from neuraminidase__InfluenzaA__AHL90845

SEQ ID NO: 146670 - RNA, 1413 nt, Artificial Sequence; identical to SEQ ID NO: 140946
  derived and/or modified sequence opt3 from neuraminidase__InfluenzaA__AHL90857

SEQ ID NO: 146671 - RNA, 1413 nt, Artificial Sequence; identical to SEQ ID NO: 139477
  derived and/or modified sequence opt3 from neuraminidase__InfluenzaA__AHL90869

SEQ ID NO: 146672 - RNA, 1413 nt, Artificial Sequence
  derived and/or modified sequence opt3 from neuraminidase__InfluenzaA__AHL90881
augaaccccaaucagaagaucauuaccauaggcagcaucuccauugccaucgggauuaucucuacaaugcugcaaauaggaucaaucauuaguaucugggcuagccacuccauucagacugguucucagaacaauacgggcaucugcaaccagagaauaauuaccuacgaaaauucgacaugggugaaccauacuuaugucaauaucaacaauaccaacguuguggcaggggaggacaaaacaucaguaacccucgccggaaauagcagucuuuguuccauuucuggcugggcgaucuacacuaaggauaacagcaucaggauugguuccaaaggggacguguucgucauacgggagccuuuuaucucaugcagucaccuggaaugucgcacauucuuuuugacccaaggagcuuuacugaaugauaagcauagcaacggcacggugaaagaccgaucuccauaucgugcccuaauguccugcccgcucggcgaggcacccucaccuuacaauagcaaguucgaaaguguugccuggucugcuuccgcaugucacgaugggaugggauggcugacuauugguaucagcggcccagacaacggggccguggcuguccuuaaguauaacggaauaauuaccggcacaaucaaaucguggaagaaacagauccugagaacucaggagucugagugcguguguaugaaugguuccugcuuuaccauuaugacagaugggcccucaaacaaggccgcgaguuacaaaaucuucaagauugaaaagggaaaaguaaccaagagcauagaguugaaugcaccuaacuuuuauuacgaagaguguuccugcuacccagacacgggcaucguuaugugugugugcagggauaauuggcauggcucuaaccggcccugggucagcuucaaucagaaccucgacuaucaaauuggguacaucugcucaggaguguuuggugauaauccucgcccagaggacggcgaagggaguuguaacccggugacugucgauggagccaauggcguuaaagguuucuccuauaaguacgggaacggcguguggaucggaagaacaaaaagcaauaggcugauuaagggcuuugagaugauaugggaccccaacggguggaccaauacugacucugauuucucaguaaaacaggacguggucgcuaucacagauuggaguggauauagcgguuccuuugugcagcacccugaacugaccggccucgacugcauucggccauguuucuggguugaguuagugcgcgggcugccccgagaaaacacgaccaucuggacaucuggaucgagcauuuccuucugcggcgucaacucagauacugccaauuggaguuggccugacggugcagagcuuccauuuaccaucgauaaguga

SEQ ID NO: 146673 - RNA, 1413 nt, Artificial Sequence; identical to SEQ ID NO: 141953
  derived and/or modified sequence opt3 from neuraminidase__InfluenzaA__AHL90893

SEQ ID NO: 146674 - RNA, 1413 nt, Artificial Sequence; identical to SEQ ID NO: 140946
  derived and/or modified sequence opt3 from neuraminidase__InfluenzaA__AHL90905

SEQ ID NO: 146675 - RNA, 1413 nt, Artificial Sequence
  derived and/or modified sequence opt3 from neuraminidase__InfluenzaA__AHL90917
augaaccccaaucagaagaucauuaccauaggcagcaucuccauugccaucgggauuaucucucugacacuccaaauaggaaacaucauuucaaucugggcuagucacagcauucagacugguucccagaauaacacgggcaucugcaaucagagaauaauuaccuacgagaacucuacaugggugaaucauacuuaugucaacaucaauaacaccaauguuguggcaggggaagacaaaacaucgguaacccuugccggaaacucaagccuguguaguauuuccggcugggcgaucuacacuaaggauaauucuaucaggauugguagcaaaggggacguguucgucauacgggagccuuuuaucuccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuauugguaucuccggcccagacaacggggccguggcuguccugaaguauaauggaauaauuaccggcacaaucaaaagcuggaagaaacagaucuugagaacucaggagucggagugcguguguaugaacgguucuugcuuuaccauuaugacagaugggcccuccaauaaggccgcgucauacaaaaucuucaagauugaaaagggaaaaguaaccaagaguauagagcucaacgcaccuaauuuuuauuacgaagaguguagcugcuacccagacacgggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacugucgauggagccaacggcguuaaagguuucaguuauaaguacgggaauggcguguggaucggaagaacaaaauccaacaggcugcggaagggcuuugagaugauuugggaccccaauggguggaccaacacugacagcgauuucucuguaaaacaggacguggucgcuauaacagauuggucaggauauagugguagcuuugugcagcacccugaacucaccggcuuagacugcauccgcccauguuucuggguugagcuggugcgagggcuucccagagaaaacacgaccauuuggacauccggaucuucgaucagcuucugcggcgucaauuccgauacugccaacuggucauggccugacggugcagaguugccauuuaccauugauaaguga

SEQ ID NO: 146676 - RNA, 1413 nt, Artificial Sequence
  derived and/or modified sequence opt3 from neuraminidase__InfluenzaA__AHL90929
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgaugacacuugccggaaacucaagccuguguaguauuuccggcugggcgaucuacaccaaggauaauucuaucaggauugguagcaaaggggacguauucgugauacgggagccuuuuaucuccugcucacacuuggaaugucgcacuuucuuuuuaacacaaggagcucugcuaaacgauaagcauaguaauggcaccgucaaagaccgaagcccauaucgugcccucaugucuugcccgcugggcgaggcacccuccccuuacaacucaaaguucgaaagcguggccuggagugcuucugcaugucacgaugggaugggauggcuuacgauugguaucuccggcccagacaacggggccguugcugugcugaaguauaauggaauaauuacuggcaccaucaaaagcuggaagaaacagaucuugagaacacaggagucggagugcgucuguaugaacgguucuugcuuuacuauuaugaccgaugggcccuccaauaaggccgcgucauacaaaaucuucaagauugaaaagggaaaagugacaaagaguauagagcucaacgcaccuaauuuuuauuacgaagaguguagcugcuacccagacaccggcaucguaauguguguuugcagggauaacuggcauggcuccaaucggcccugggugucuuucaaccagaaucuggacuaucaaauuggguacaucugcagcggagucuuuggugauaacccucgcccagaggacggcgaagggucauguaauccggugacgguggauggagccaacggcgucaaagguuucaguuauaaguacgggaauggcguuuggaucggaagaacuaaauccaacaggcugcggaagggcuuugagaugauuugggaccccaauggguggacaaacaccgacagcgauuucucugugaaacaggacguaguggcuauaacugauuggucaggauauagugguagcuuuguccagcacccugaacucacaggcuuagacugcauccgcccauguuucuggguggagcugguucgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 146677 - RNA, 1413 nt, Artificial Sequence; identical to SEQ ID NO: 140946
  derived and/or modified sequence opt3 from neuraminidase__InfluenzaA__AHL90941

SEQ ID NO: 146678 - RNA, 1413 nt, Artificial Sequence; identical to SEQ ID NO: 140946
  derived and/or modified sequence opt3 from neuraminidase__InfluenzaA__AHL90953

SEQ ID NO: 146679 - RNA, 1413 nt, Artificial Sequence; identical to SEQ ID NO: 140946
  derived and/or modified sequence opt3 from neuraminidase__InfluenzaA__AHL90965

SEQ ID NO: 146680 - RNA, 1413 nt, Artificial Sequence
  derived and/or modified sequence opt3 from neuraminidase__InfluenzaA__AHL90977
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauagccgauuggucaggauauagugguagcuuugugcagcacccugaacucacuggcuuagacugcauccgcccauguuucuggguugagcuggugcgagggcuucccagagaaaacacaaccauuuggacguccggaucuucgaucagcuucugcggcgucaauuccgauaccgcaaacuggucauggccugacggugcugaguugccauuuacaauugauaaguga

SEQ ID NO: 146681 - RNA, 1413 nt, Artificial Sequence; identical to SEQ ID NO: 142220
  derived and/or modified sequence opt3 from neuraminidase__InfluenzaA__AHL90989

SEQ ID NO: 146682 - RNA, 1413 nt, Artificial Sequence; identical to SEQ ID NO: 146676
  derived and/or modified sequence opt3 from neuraminidase__InfluenzaA__AHL91001

SEQ ID NO: 146683 - RNA, 1413 nt, Artificial Sequence
  derived and/or modified sequence opt3 from neuraminidase__InfluenzaA__AHL91013
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcucucagagaauaauuacguacgaaaauucgaccugggugaaccauacauaugucaauaucaacaauacuaacguuguggcaggggaggacaaaaccucaaugacacuugccggaaauagcagucuguguuccauuucuggcugggcgaucuacaccaaggauaacagcaucaggauugguuccaaaggggacguauucgugauacgggagccuuuuaucucaugcagucacuuggaaugucgcacuuucuuuuuaacacaaggagcucugcuaaaugauaagcauagcaacggcaccgucaaagaccgaucuccauaucgugcccucauguccugcccgcugggcgaggcacccucaccuuacaauagcaaguucgaaaguguggccuggucugcuuccgcaugucacgaugggaugggauggcuuacgauugguaucagcggcccagacaacggggccguugcugugcugaaguauaacggaauaauuacuggcaccaucagaucguggaaaaagcagaucuugaggacacaggagucugagugcgucuguaugaaugguuccugcuuuacuauuaugaccgaugggcccucaaacaaagccgcgaguuacaagaucuucaaaauugaaaagggaaaggugacaaaaagcauagagcucaaugcaccuaacuuuuauuacgaagaguguuccugcuacccagacaccggcaucguaauguguguuugccgggauaauuggcauggcucuaaccgccccugggugagcuucaaucagaaccuggacuaucaaauuggguacaucugcucaggagucuuuggugauaauccuagaccagaggacggcgaagggaguuguaacccggugacgguggauggagccaauggcgucaaggguuucuccuauaaauacgggaacggcguuuggaucggaaggacuaagagcaaucggcugcgcaaaggcuuugagaugauuugggaccccaacggguggacaaauaccgacucugauuucucagugaagcaggacguaguggcuauaacugauuggaguggauauagcgguuccuuuguccagcacccugaacucacaggcuuagacugcauccgaccauguuucuggguggagcugguuagagggcuucccagggaaaacaccacgauuuggaccucuggaucgagcaucuccuucugcggcgugaacucagauacagccaauuggaguuggccugacggugcagaguugccauuuacuauugauaaauga

SEQ ID NO: 146684 - RNA, 1413 nt, Artificial Sequence; identical to SEQ ID NO: 146676
  derived and/or modified sequence opt3 from neuraminidase__InfluenzaA__AHL91025

SEQ ID NO: 146685 - RNA, 1410 nt, Artificial Sequence; identical to SEQ ID NO: 139921
  derived and/or modified sequence opt3 from neuraminidase__InfluenzaA__AHL91037

SEQ ID NO: 146686 - RNA, 1410 nt, Artificial Sequence; identical to SEQ ID NO: 141534
  derived and/or modified sequence opt3 from neuraminidase__InfluenzaA__AHL91049

SEQ ID NO: 146687 - RNA, 1410 nt, Artificial Sequence
  derived and/or modified sequence opt3 from neuraminidase__InfluenzaA__AHL91061
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuuaacccuaauaacgaggaaggugggcacggaguuaaaggcugggcuuucgacgauggcaaugacguguggauggggcgaaccauuagcgagaagucaagauugggauaugagacauuuaaagucaucgaagguuggaguaaccauaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggccagacggggccgaucugaaucuuaugcccauuuga

SEQ ID NO: 146688 - RNA, 1410 nt, Artificial Sequence
  derived and/or modified sequence opt3 from neuraminidase__InfluenzaA__AHL91073
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggacauggaguaagccucagugugacauaaccggguucgcaccauuuagcaaagauaauuccauucggcugucugccggaggugacaucuggguaacgcgcgagcccuaugugucgugcgauccugacaaguguuaccaauucgcgcuaggccaggggacuacccucaacaauguccauucaaacaauacagugcgagaucguacuccauauagaacccugcuuaugaacgaacugggaguucccuuucacuugggcacaaaacaggugugcauugcuuggagcaguuccucuugucaugacgguaaggccuggcuccacgucugcaucaccggggaugacaagaaugcaacggccagcuucaucuacaacggaaggcugguggauuccguaguuucauggaguaaagagauucugcggacucaggaaagcgagugugugugcauaaauggcacauguaccgucgugaugacugacggcucugcuuccgggaaggcagauacaaaaauccucuuuauugaggaaggaaagaucgugcauaccucaacguuaagcgguagugcccaacacgucgaggaaugcucuugcuauccucgcuacccaggcguuagaugugugugcagggacaacuggaagggguccaaccggccgauaguagauauuaauaucaaagaccacagcaucgugucgucuuacgucuguuccggacuggugggcgacacccccaggaagaacgauucaaguagcgguucccauugccuugacccuaauaacgaggaagggggacacggcguuaaaggcugggcuuucgaugacgggaaugauguguggaugggacgaacaauuucugaaaagagcagauuggguuaugagacuuuuaaagucaucgagggcuggucaaaccauaagaguaaacugcagauuaaucgccaggugauaguagaccgggggaaccguuccggauacagcggcaucuucucuguugaggguaagucauguauuaaucgcugcuuuuauguggaacuaaucagagggaggaaggaggaaaccgagguccucuggacaaguaacagcaucguggucuucuguggcacuuccggaaccuacggcacagggucuuggccagauggagccgaccugaaucuuaugcccauuuga

SEQ ID NO: 146689 - RNA, 1410 nt, Artificial Sequence
  derived and/or modified sequence opt3 from neuraminidase__InfluenzaA__AHL91085
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgaagauaaucgagagaaauauuacugaaaucguguauuugaccaacacaaccauugagaaagaaaucugccccaaguuagcugaguacaggaauuggaguaaaccucagugugacauaacuggguucgcaccauuuagcaaggauaacuccauucggcugucugccggaggugacaucuggguaacacgcgagcccuaugugucgugcgauccugacaaguguuaccaauucgcgcuaggccaggggaccacgcucaauaacguccauucaaauaacacugugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcaucuguacggucgugaugacugacggcucugcuuccgggaaagcagauacaaagauucucuuuaucgaggaaggaaagauagugcauaccucaacuuuaagcgguagugcccaacacgucgaggaaugcucuugcuauccucgcuacccaggcguuagaugugugugcagggacaacuggaaaggguccaaucggccgauuguagauaucaacaucaaggaccacagcauugugucgucuuacgucuguuccggacuggugggcgacacaccccgcaaaaaugauucaaguagcuccucucauugccuugacccuaacaaugaggaaggugggcacggaguuaagggcugggcuuucgaugacggcaacgauguguggauggggcgaaccaucagcgagaaaucaagauugggauaugagacguuuaaggucauugaagguuggaguaauccaaaauccaagcugcagauaaacaggcaagugaucguagaccggggcaaucguagcggguacucuggaauuuucucaguugagggcaagaguuguaucaaccgcugcuuuuauguggaacuaaucagagguaggaaagaggaaaccgagguccucuggacaagcaauuccauuguggucuucugugggacuucuggcaccuacggaacaggcucguggcccgauggggccgacauaaaccugaugccuaucuga

SEQ ID NO: 146690 - RNA, 1410 nt, Artificial Sequence; identical to SEQ ID NO: 138615
  derived and/or modified sequence opt3 from neuraminidase__InfluenzaA__AHL91097

SEQ ID NO: 146691 - RNA, 1410 nt, Artificial Sequence
  derived and/or modified sequence opt3 from neuraminidase__InfluenzaA__AHL91109
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaaucauaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggccagauggggccgaccugaacauuaugcccauauga

SEQ ID NO: 146692 - RNA, 1410 nt, Artificial Sequence; identical to SEQ ID NO: 139921
  derived and/or modified sequence opt3 from neuraminidase__InfluenzaA__AHL91121

SEQ ID NO: 146693 - RNA, 1410 nt, Artificial Sequence
  derived and/or modified sequence opt3 from neuraminidase__InfluenzaA__AHL91133
augaaccccaaucagaagaucauuaccauaggcagcgugucccugacaaucucuacuauuugcuucuuuaugcagaucgccauucucaucacgaccgucacacuucacuucaaacaguuugaguucaacucaccuccaaauaaccagguuaugcugugugaaccgacuauaaucgagagaaauauuaccgaaaucguguacuugacaaacaccacuauugagaaggaaaucugccccaaauuagcugaguauaggaauuggaguaagccucagugugacauaacaggguuugcaccauucagcaaagauaacuccauucggcugucugccggaggugacaucuggguaacccgcgagcccuacgugucgugcgauccugacaaguguuaucaauuugcgcuaggccaggggacgacucucaauaacguccauucaaauaacaccgugcgagaucguacaccauacagaacucugcuuaugaaugaacugggaguucccuuccacuugggcaccaaacaggugugcauugcuuggagcaguuccucuugucaugacgguaaggccuggcuccacgucugcaucacaggggaugacaagaacgcaaccgccagcuuuaucuauaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuucauugaggaaggaaagaucgugcauacaucaaccuuaagcgguagugcccaacacgucgaggaaugcucuugcuacccucgcuauccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuuugaugacggcaacgauguguggauggggcgaaccauuagcgagaagucaagauugggauacgagacauucaaagucaucgaagguuggaguaaucauaaguccaaacugcagauuaacaggcaagugauaguagaccggggcaaucguagcggguauucuggaaucuuuucaguugagggcaagaguuguauuaaccgcugcuucuacguggaacuaaucagagguaggaaggaggaaacugagguccucuggaccagcaauuccaucguggucuucugugggacaucuggcacuuauggaaccggcucguggccagauggggccgaccugaaccuuaugcccauuuga

SEQ ID NO: 146694 - RNA, 1410 nt, Artificial Sequence; identical to SEQ ID NO: 141320
  derived and/or modified sequence opt3 from neuraminidase__InfluenzaA__AHL91145

SEQ ID NO: 146695 - RNA, 1410 nt, Artificial Sequence; identical to SEQ ID NO: 141320
  derived and/or modified sequence opt3 from neuraminidase__InfluenzaA__AHL91157

SEQ ID NO: 146696 - RNA, 1410 nt, Artificial Sequence; identical to SEQ ID NO: 136728
  derived and/or modified sequence opt3 from neuraminidase__InfluenzaA__AHL91169

SEQ ID NO: 146697 - RNA, 1410 nt, Artificial Sequence; identical to SEQ ID NO: 144162
  derived and/or modified sequence opt3 from neuraminidase__InfluenzaA__AHL94987

SEQ ID NO: 146698 - RNA, 1410 nt, Artificial Sequence; identical to SEQ ID NO: 144162
  derived and/or modified sequence opt3 from neuraminidase__InfluenzaA__AHL94999

SEQ ID NO: 146699 - RNA, 1410 nt, Artificial Sequence
  derived and/or modified sequence opt3 from neuraminidase__InfluenzaA__AHL95011
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauuccucaaguagcucccauugccuggacccaaacaaugaggaaggugggcacggaguuaaaggcugggcuuucgaugacggcaacgauguguggauggggagaaccauuaaugagacaucuaggcuuggauaugagacuuuuaaggucaucgaagguugguucaaccccaaaagcaaguugcagauuaaucgucaggugauaguagaccggggcgaucgcucaggguacaguggaaucuuuuccguugagggcaaaagcuguauuaacagaugcuucuauguggaacugaucaggggucggaaggaggaaaccgagguccuauggacaucuaauucaaucguggucuucugugggaccaguggcacuuacggaacaggcagcuggccugacggggccgaucucaaccugaugccaauuuga

SEQ ID NO: 146700 - RNA, 1410 nt, Artificial Sequence; identical to SEQ ID NO: 145919
  derived and/or modified sequence opt3 from neuraminidase__InfluenzaA__AHL95023

SEQ ID NO: 146701 - RNA, 1410 nt, Artificial Sequence; identical to SEQ ID NO: 144162
  derived and/or modified sequence opt3 from neuraminidase__InfluenzaA__AHL95035

SEQ ID NO: 146702 - RNA, 1410 nt, Artificial Sequence; identical to SEQ ID NO: 144162
  derived and/or modified sequence opt3 from neuraminidase__InfluenzaA__AHL95047

SEQ ID NO: 146703 - RNA, 1410 nt, Artificial Sequence; identical to SEQ ID NO: 145910
  derived and/or modified sequence opt3 from neuraminidase__InfluenzaA__AHL95059

SEQ ID NO: 146704 - RNA, 1410 nt, Artificial Sequence; identical to SEQ ID NO: 144162
  derived and/or modified sequence opt3 from neuraminidase__InfluenzaA__AHL95071

SEQ ID NO: 146705 - RNA, 1410 nt, Artificial Sequence; identical to SEQ ID NO: 144162
  derived and/or modified sequence opt3 from neuraminidase__InfluenzaA__AHL95083

SEQ ID NO: 146706 - RNA, 1410 nt, Artificial Sequence; identical to SEQ ID NO: 144162
  derived and/or modified sequence opt3 from neuraminidase__InfluenzaA__AHL95095

SEQ ID NO: 146707 - RNA, 1410 nt, Artificial Sequence; identical to SEQ ID NO: 144162
  derived and/or modified sequence opt3 from neuraminidase__InfluenzaA__AHL95107

SEQ ID NO: 146708 - RNA, 1410 nt, Artificial Sequence
  derived and/or modified sequence opt3 from neuraminidase__InfluenzaA__AHL95119
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauucccugucaaguagccauugccuugacccaaacaaugaggaaggugggcacggaguuaaaggcugggcuuucgaugacggcaacgauguguggauggggagaaccauuaaugagacauccagguugggauaugagacuuuuaaggucaucgaagguuggucuaaccccaaaagcaagcugcagauuaaucgucaggugauaguagaccggggcgaucgcucaggguacaguggaaucuucuccguugagggcaaaagcuguauuaacagaugcuuuuauguggaacuaaucaggggucggaaggaggaaaccgagguccucuggacaucuaauucaaucguggucuucugugggaccaguggcacuuacggaacaggcagcuggccugacggggccgaucugaaccuuaugccaauuuga

SEQ ID NO: 146709 - RNA, 1410 nt, Artificial Sequence; identical to SEQ ID NO: 145391
  derived and/or modified sequence opt3 from neuraminidase__InfluenzaA__AHL95131

SEQ ID NO: 146710 - RNA, 1410 nt, Artificial Sequence; identical to SEQ ID NO: 145899
  derived and/or modified sequence opt3 from neuraminidase__InfluenzaA__AHL95143

SEQ ID NO: 146711 - RNA, 1410 nt, Artificial Sequence
  derived and/or modified sequence opt3 from neuraminidase__InfluenzaA__AHL95155
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggagccacggaguuaaaggcugggcuuucgacgauggcaacgacguguggauggggcgaaccauuaaugagacaucaagacuuggauaugagacuuuuaaggucaucgaagguuggaguaaccccaaauccaaguugcagauuaauaggcaagugauaguagaucggggcgaccguagcggguacucuggaaucuucucaguugagggcaaaaguuguauuaaccgcugcuuuuauguggaacugaucagagguaggaaggaggaaaccgagguccuauggacaagcaauuccaucguggucuucugugggacuucuggcaccuacggaacaggcucguggccugauggggccgaccucaaccugaugccaauuuga

SEQ ID NO: 146712 - RNA, 1410 nt, Artificial Sequence
  derived and/or modified sequence opt3 from neuraminidase__InfluenzaA__AHL95167
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacuuauguucuggacuggucggcgacacgccucgaaagaaugauuccucaaguagcucccauugccuugacccaaacaaugaggaaggugggcacggagugaaaggcugggcuuucgaugacggcaacgauguuuggauggggagaaccauuaaugagacaucuagguugggauaugagacuuuuaaggugaucgaagguuggagcaaccccaaaucaaagcugcagauuaaucggcaggucauaguggaccguggcgaucgcaguggguacuccggaaucuucagcguagagggcaaaucuuguauuaacagaugcuuuuauguugaacuaaucaggggucggaaggaggaaaccgaggugcucuggacaucaaauaguaucgucguguucugugggacuagcggcaccuacggaacaggcuccuggccugacggggccgaucugaaccuuaugccaauuuga

SEQ ID NO: 146713 - RNA, 1410 nt, Artificial Sequence; identical to SEQ ID NO: 144162
  derived and/or modified sequence opt3 from neuraminidase__InfluenzaA__AHL95179

SEQ ID NO: 146714 - RNA, 1410 nt, Artificial Sequence; identical to SEQ ID NO: 144162
  derived and/or modified sequence opt3 from neuraminidase__InfluenzaA__AHL95191

SEQ ID NO: 146715 - RNA, 1410 nt, Artificial Sequence; identical to SEQ ID NO: 144162
  derived and/or modified sequence opt3 from neuraminidase__InfluenzaA__AHL95203

SEQ ID NO: 146716 - RNA, 1410 nt, Artificial Sequence; identical to SEQ ID NO: 144162
  derived and/or modified sequence opt3 from neuraminidase__InfluenzaA__AHL95215

SEQ ID NO: 146717 - RNA, 1410 nt, Artificial Sequence
  derived and/or modified sequence opt3 from neuraminidase__InfluenzaA__AHL95227
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcgagaaugacucaaguagcuccucucauugccuggauccaaacaaugaagaagggggacacggcgugaagggcugggcuuucgacgaugggaacgacguuuggaugggacgaaccauuaaugagacaagcagacuugguuaugagacuuuuaaagugaucgagggcuggucaaaccccaagaguaaauugcagauuaauaggcaggucauaguggaucguggggaccgguccggauacagcggcaucuucucuguagaagguaagucauguauuaaccgcugcuuuuauguugagcugaucagagggaggaaagaagagaccgaggugcuauggacaaguaauagcaucgucguguucuguggcacuuccggaaccuacggcacagggucuuggccugauggagccgaccucaaccugaugccaauuuga

SEQ ID NO: 146718 - RNA, 1410 nt, Artificial Sequence; identical to SEQ ID NO: 145899
  derived and/or modified sequence opt3 from neuraminidase__InfluenzaA__AHL95239

SEQ ID NO: 146719 - RNA, 1410 nt, Artificial Sequence
  derived and/or modified sequence opt3 from neuraminidase__InfluenzaA__AHL95251
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauuaaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaggaagagaccgaaguccuauggacaaguaauagcaucguggucuucuguggcacuuccggaaccuacggcacagggucuuggccugauggagccgaccucaaccugaugccaauuuga

SEQ ID NO: 146720 - RNA, 1410 nt, Artificial Sequence; identical to SEQ ID NO: 144162
  derived and/or modified sequence opt3 from neuraminidase__InfluenzaA__AHL95263

SEQ ID NO: 146721 - RNA, 1410 nt, Artificial Sequence
  derived and/or modified sequence opt3 from neuraminidase__InfluenzaA__AHL95275
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacauuaccaucgagaaggaaauaugccccaaaccugcugaguacaggaauuggaguaagccacagugugggauuacuggauucgcacccuuuagcaaagacaacuccauccgguuaucugccgguggcgauauuuggguaacacgcgagccuuaugugucgugcgacccagauaaguguuaccaauucgcgcuggggcagggaaccacgcuaaauaacguccauucaaauaacacugugcgagaccguacccccuauagaacacuccugaugaaugaacuuggcguuccuuuucaccuggguacuaaacaggugugcaucgcuuggagcaguuccucuugucaugaugggaaggccugguugcacgucugcaucaccggagacgauaagaacgcaacagccagcuucauuuacaauggcaggcucguggacuccguaguuucauggaguaaagagauacugcggacccaggaaagcgagugugugugcaucaacggcacguguacugucgugaugacagaugggucugcuuccggaaaggcagacaccaaaauucuguuuaucgaggaagguaagauagugcauacuucaacacucagcggcagugcccaacacgucgaggaaugcucuugcuauccacgcuacccggggguuagaugugugugcagggauaacuggaagggauccaaucggcccauuguagacaucaacaucaaagaucacagcauugugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacgaucaaugagaccagcagacuugguuaugagacauuuaaggucauugaaggcuggucaaaccccaaaaguaaguugcagauaaauaggcaagugaucguagaucguggggaccgguccggauacagcggcauuuucucuguugaggguaaaucauguaucaaccgcugcuuuuauguggaacugaucagagggaggaaggaggaaacugagguccuauggaccaguaauagcauuguggucuucuguggcacauccggaacuuacggcaccgggucuuggccugauggagccgaccucaaccugaugccaauauga

SEQ ID NO: 146722 - RNA, 1410 nt, Artificial Sequence; identical to SEQ ID NO: 145405
  derived and/or modified sequence opt3 from neuraminidase__InfluenzaA__AHL95299

SEQ ID NO: 146723 - RNA, 1410 nt, Artificial Sequence
  derived and/or modified sequence opt3 from neuraminidase__InfluenzaA__AHL95310
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauuccucaaguagcucccauugccuggacccaaacaaugaggaaggugggcacggaguuaaaggcugggcuuucgaugacggcaacgauguguggauggggagaaccauuaaugagacaucuaggcuuggauaugagacuuuuaaggucaucgaagguuggagcaaccccaaaucaaaguugcagauuaaucgucaggugauaguagaccggggcgaucgcaguggguacuccggaaucuucagcguugagggcaaaucuuguauuaacagaugcuuuuauguggaacugaucaggggucggaaggaggaaaccgagguccuauggacaucaaauaguaucguggucuucugugggacuagcggcaccuacggaacaggcuccuggccugacggggccaaccucaaucugaugccaauuuga

SEQ ID NO: 146724 - RNA, 1410 nt, Artificial Sequence; identical to SEQ ID NO: 145910
  derived and/or modified sequence opt3 from neuraminidase__InfluenzaA__AHL95322

SEQ ID NO: 146725 - RNA, 1410 nt, Artificial Sequence; identical to SEQ ID NO: 145887
  derived and/or modified sequence opt3 from neuraminidase__InfluenzaA__AHL95334

SEQ ID NO: 146726 - RNA, 1410 nt, Artificial Sequence; identical to SEQ ID NO: 144162
  derived and/or modified sequence opt3 from neuraminidase__InfluenzaA__AHL95423

SEQ ID NO: 146727 - RNA, 1410 nt, Artificial Sequence; identical to SEQ ID NO: 145910
  derived and/or modified sequence opt3 from neuraminidase__InfluenzaA__AHL95435

SEQ ID NO: 146728 - RNA, 1410 nt, Artificial Sequence; identical to SEQ ID NO: 145887
  derived and/or modified sequence opt3 from neuraminidase__InfluenzaA__AHL95447

SEQ ID NO: 146729 - RNA, 1410 nt, Artificial Sequence
  derived and/or modified sequence opt3 from neuraminidase__InfluenzaA__AHL95461
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaaccagcugaguacaggaauuggucaaagccccagugugggauaacaggauucgcaccuuuuaguaaagacaacagcauucgguuauccgccgguggcgauaucuggguaacccgcgagccauaugugucuugcgggcccgacaaguguuaccaauucgcgcugggacagggcacgacucuaaauaacaugcauucgaauaacaccguccgagaucguacaccuuauagaacucuccugaugaaugaacuuggugugccauuucaccuggggaccaagcagguuugcauugcuuggucaagcaguuccugucaugacggaaaagccugguugcacgugugcaucacaggcgaugacaagaacgcaaccgccucuuucaucuacaauggcaggcucgucgauagcgugguauccuggucaaaagagauucugcggacgcaggaaagugaguguguuugcauaaacgggacuuguacaguggucaugaccgacggaagcgcuucugguaaggcagauacuaaaauccuguuuauugaggaaggcaagaucgugcauacauccacccucucagggagcgcccaacacguggaggaaugcaguugcuauccgcgcuaccccggagucagauguguuugcagggacaacuggaagggcucuaaucggccuauaguggauauuaacaucaaagaccacuccaucguaagcucguacguguguucugguuuagucggggauacgccacgcaagaaugacuccucaaguagcucccauugccuggaccccaacaaugaggaaggaggccacggcgugaaagggugggcuuucgaugacggaaacgauguuuggaugggucgaaccauuaaugagacaucuagacuuggcuaugagacuuuuaaggugaucgaaggguggagcaacccuaaaucaaaguugcagauuaauaggcaggucauaguggaccggggagaucguaguggcuacuccgguaucuucagcguagaggggaaaucuuguauuaaccgcugcuuuuauguugaacugaucagaggcaggaaggaggaaaccgaggugcuauggacaucaaauaguaucgucguguucuguggaacuagcggcaccuacgggacaggauccuggccagacggugccgaucucaaccugaugcccauuuga

SEQ ID NO: 146730 - RNA, 1410 nt, Artificial Sequence; identical to SEQ ID NO: 144938
  derived and/or modified sequence opt3 from neuraminidase__InfluenzaA__AHL95473

SEQ ID NO: 146731 - RNA, 1410 nt, Artificial Sequence; identical to SEQ ID NO: 144162
  derived and/or modified sequence opt3 from neuraminidase__InfluenzaA__AHL95485

SEQ ID NO: 146732 - RNA, 1410 nt, Artificial Sequence; identical to SEQ ID NO: 144162
  derived and/or modified sequence opt3 from neuraminidase__InfluenzaA__AHL95497

SEQ ID NO: 146733 - RNA, 1410 nt, Artificial Sequence
  derived and/or modified sequence opt3 from neuraminidase__InfluenzaA__AHL95509
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaaaaucacagcaucgugucgucuuacgucuguuccggcuuagugggugauacgccucgcaagaacgacucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 146734 - RNA, 1410 nt, Artificial Sequence; identical to SEQ ID NO: 144162
  derived and/or modified sequence opt3 from neuraminidase__InfluenzaA__AHL95521

SEQ ID NO: 146735 - RNA, 1410 nt, Artificial Sequence; identical to SEQ ID NO: 144162
  derived and/or modified sequence opt3 from neuraminidase__InfluenzaA__AHL95533

SEQ ID NO: 146736 - RNA, 1410 nt, Artificial Sequence; identical to SEQ ID NO: 144162
  derived and/or modified sequence opt3 from neuraminidase__InfluenzaA__AHL95545

SEQ ID NO: 146737 - RNA, 1410 nt, Artificial Sequence
  derived and/or modified sequence opt3 from neuraminidase__InfluenzaA__AHL95557
augaaccccaaucagaagaucauuaccauaggcagcgugucccugacaaucucuacuauuugcuucuuuauccaaauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaaccugcugaguacaggaauuggaguaagccacagugugggauuacaggauucgcacccuuuagcaaagacaacuccauccgguuaucugccgguggcgauauuuggguaacccgcgagccuuaugugucgugcgacccagauaaguguuaccaauucgcgcuggggcagggaacgacucuaaauaacguccauucaaauaacaccgcucgagaccguacacccuauagaacucuccugaugaaugaacuuggcgugccuuuucaccuggguaccaagcagguuugcaucgccuggagcaguuccucuugucaugaugggaaagcaugguugcacgugugcaucacaggagacgauaagaacgccaccgcuagcuucauuuacaauggcaggcucgucgacuccgugguaucauggaguaaagagauacugcggacgcaggaaagcgaguguguuugcaucaacggcacuuguacaguggucaugaccgaugggucugcauccggaaaggccgacacuaaaauucuguuuaucgaggaagguaagauagugcauacaucaacccucagcggcagugcucaacacguggaggaaugcucuugcuauccacgcuacccgggggucagauguguuugcagggauaacuggaagggauccaaucggcccauuguggacaucaacaucaaagaucacagcauuguaucgucuuacguguguuccggcuuagucggugacacgccucgcaagaaugacucaaguagcuccucucauugccuggauccaaacaaugaggaagggggacacggcgugaaaggcugggccuucgacgaugggaacgacguuuggaugggacgaaccaucaaugagacaagcagacuugguuaugagacuuuuaaggugauugaaggcuggucaaaccccgagaguaaauugcagauaaauaggcaggucaucguggaucguggggaccgguccggauacagcggcauuuucucuguagaagguaagucauguaucaaccgcugcuuuuauguugagcugaucagagggaggaaagaagagaccgaggugcuauggacaaguaauagcauugucguguucuguggcacuuccggaaccuacggcacagggucuuggccugauggagcggaccucaaccugaugccaauauga

SEQ ID NO: 146738 - RNA, 1410 nt, Artificial Sequence; identical to SEQ ID NO: 145887
  derived and/or modified sequence opt3 from neuraminidase__InfluenzaA__AHL95569

SEQ ID NO: 146739 - RNA, 1410 nt, Artificial Sequence; identical to SEQ ID NO: 144162
  derived and/or modified sequence opt3 from neuraminidase__InfluenzaA__AHL95581

SEQ ID NO: 146740 - RNA, 1410 nt, Artificial Sequence
  derived and/or modified sequence opt3 from neuraminidase__InfluenzaA__AHL95605
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacauuucaaguagcucccauugccuggauccaaacaaugaggaagggggacacggcguuaaaggcugggcuuucgacgaugggaacgacguguggaugggacgaaccaucaaugagacaucuagacuugguuaugagacuuuuaaggucauugaaggcuggagcaaccccaaaucaaaguugcagauaaauaggcaagugaucguagaucguggggaccggaguggauacuccggcauuuucagcguugaggguaaaucuuguaucaaccgcugcuuuuauguggaacugaucagagggaggaaggaggaaaccgagguccuauggacaucaaauaguauuguggucuucuguggcacuagcggaaccuacggcacaggguccuggccugauggagccgaccucaaccugaugccaauauga

SEQ ID NO: 146741 - RNA, 1410 nt, Artificial Sequence; identical to SEQ ID NO: 144162
  derived and/or modified sequence opt3 from neuraminidase__InfluenzaA__AHL95617

SEQ ID NO: 146742 - RNA, 1410 nt, Artificial Sequence; identical to SEQ ID NO: 144162
  derived and/or modified sequence opt3 from neuraminidase__InfluenzaA__AHL95629

SEQ ID NO: 146743 - RNA, 1410 nt, Artificial Sequence; identical to SEQ ID NO: 144162
  derived and/or modified sequence opt3 from neuraminidase__InfluenzaA__AHL95641

SEQ ID NO: 146744 - RNA, 1410 nt, Artificial Sequence; identical to SEQ ID NO: 144162
  derived and/or modified sequence opt3 from neuraminidase__InfluenzaA__AHL95653

SEQ ID NO: 146745 - RNA, 1410 nt, Artificial Sequence; identical to SEQ ID NO: 146740
  derived and/or modified sequence opt3 from neuraminidase__InfluenzaA__AHL95665

SEQ ID NO: 146746 - RNA, 1410 nt, Artificial Sequence; identical to SEQ ID NO: 144162
  derived and/or modified sequence opt3 from neuraminidase__InfluenzaA__AHL95677

SEQ ID NO: 146747 - RNA, 1410 nt, Artificial Sequence
  derived and/or modified sequence opt3 from neuraminidase__InfluenzaA__AHL95689
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccaaucucaaccugaugccaauuuga

SEQ ID NO: 146748 - RNA, 1410 nt, Artificial Sequence; identical to SEQ ID NO: 144162
  derived and/or modified sequence opt3 from neuraminidase__InfluenzaA__AHL95701

SEQ ID NO: 146749 - RNA, 1410 nt, Artificial Sequence; identical to SEQ ID NO: 144162
  derived and/or modified sequence opt3 from neuraminidase__InfluenzaA__AHL95713

SEQ ID NO: 146750 - RNA, 1410 nt, Artificial Sequence
  derived and/or modified sequence opt3 from neuraminidase__InfluenzaA__AHL95725
augaaccccaaucagaagaucauuaccauaggcagcgugucccugacaaucucuacuauuugcuucuuuaugcagaucgccauucucaucacgaccgucacacuucacuucaaacaguacgaguuugacccuccaccgaacaaucagguuaugcugugugaacccacuauaaucgagagaaacauuaccgaaaucguguauuugacaaauaccacuauugagaaggaaaucugcccuaaaccagcugaguacaggaacuggucaaagccccagugugggauaacaggauucgcaccuuuuaguaaagauaauagcauucgguuauccgccgguggcgacaucuggguaacccgcgagccauaugugucuugcgaucccgacaaguguuaccaauucgcgcuggggcagggaacgacucuaaacaauguccauucgaacaauaccgugcgagaucguacaccuuauagaacucuccugaugaacgaacuuggcguuccauuucaccuggguaccaaacaggugugcauugcuuggucaagcaguuccugucaugacgggaaggccugguugcacgucugcaucacaggagaugacaagaaugcaaccgccucuuucaucuacaacggcaggcucguggauagcguaguuuccuggucaaaagagauucugcggacgcaggaaagugagugugugugcauaaauggcacuuguacagucgugaugaccgacgggagcgcuucuggaaaggcagauacuaaaauccuguuuauugaggaagguaagaucgugcauacauccacccucucaggcagcgcccaacacgucgaggaaugcaguugcuauccgcgcuaccccgggguuagaugugugugcagggacaacuggaagggaucuaaccggccuauaguagauauuaauaucaaagaccacuccaucgugagcucguacgucuguucuggcuuagugggugacacgccacgcaagaacgauuccucaaguagcucccauugccuggaccccaauaacgaggaagggggacacggcguuaaaggcugggcuuucgaugacgggaaugauguguggaugggacgaaccauuaacgagacaucuagacuugguuaugagacuuuuaaggucaucgaaggcuggagcaauccuaaaucaaaguugcagauuaacaggcaagugauaguagaccguggggaucggaguggauacuccggcaucuucagcguugaggguaaaucuuguauuaaucgcugcuuuuauguggaacugaucagagggaggaaggaggaaaucgagguccuauggaccucaaacaguauuguggucuucuguggcacaagcggaacuuacggcaccggguccuggccagacggagccgaucucaaucugaugcccauauga

SEQ ID NO: 146751 - RNA, 1410 nt, Artificial Sequence; identical to SEQ ID NO: 145899
  derived and/or modified sequence opt3 from neuraminidase__InfluenzaA__AHL95737

SEQ ID NO: 146752 - RNA, 1410 nt, Artificial Sequence
  derived and/or modified sequence opt3 from neuraminidase__InfluenzaA__AHL95749
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgcucgagaccguacacccuauagaacucuccugaugaaugaacuuggcgugccuuuucaccuggguaccaagcagguuugcauugccuggagcaguuccucuugucaugaugggaaagcaugguugcacgugugcaucacaggagacgauaagaacgccaccgcuagcuucaucuacaauggcaggcucgucgacuccgugguaucauggaguaaagagauucugcggacgcaggaaagcgaguguguuugcauaaacggcacuuguacaguggucaugaccgaugggucugcauccggaaaggccgacacuaaaauccuguuuauugaggaagguaagaucgugcauacaucaacccucagcggcagugcucaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggccuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagcggaccucaaccugaugccaauuuga

SEQ ID NO: 146753 - RNA, 1410 nt, Artificial Sequence; identical to SEQ ID NO: 144162
  derived and/or modified sequence opt3 from neuraminidase__InfluenzaA__AHL95761

SEQ ID NO: 146754 - RNA, 1410 nt, Artificial Sequence; identical to SEQ ID NO: 144162
  derived and/or modified sequence opt3 from neuraminidase__InfluenzaA__AHL95773

SEQ ID NO: 146755 - RNA, 1410 nt, Artificial Sequence
  derived and/or modified sequence opt3 from neuraminidase__InfluenzaA__AHL95785
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccguacgguuaucugccggaggugacauuugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcaucgcuuggagcaguuccucuugucaugacgguaaagccugguugcacgugugcauuacaggggaugacaagaacgcaaccgccagcuucaucuacaauggaaggcucguagauuccguugugucauggaguaaagagauccugcggacgcaggaaagcgagugugucugcauuaacggcacuuguacaguggugaugaccgacggcucugcuuccgggaaggcagauacuaaaauacuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgucuuacguguguuccggauuaguuggcgacacgccucgcaagaaugauucaaguagcuccucucauugccuggacccaaacaaugaggaaggugggcacggagugaaaggcugggcuuucgaugacggcaacgaugucuggauggggcgaaccaucaaugagacaagcagacuuggauaugagacuuuuaaggugauugaagguuggucaaaccccaaaaguaaguugcagaucaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 146756 - RNA, 1410 nt, Artificial Sequence; identical to SEQ ID NO: 145887
  derived and/or modified sequence opt3 from neuraminidase__InfluenzaA__AHL95797

SEQ ID NO: 146757 - RNA, 1410 nt, Artificial Sequence; identical to SEQ ID NO: 144162
  derived and/or modified sequence opt3 from neuraminidase__InfluenzaA__AHL95833

SEQ ID NO: 146758 - RNA, 1410 nt, Artificial Sequence; identical to SEQ ID NO: 145887
  derived and/or modified sequence opt3 from neuraminidase__InfluenzaA__AHL95845

SEQ ID NO: 146759 - RNA, 1410 nt, Artificial Sequence
  derived and/or modified sequence opt3 from neuraminidase__InfluenzaA__AHL95857
augaaccccaaucagaagaucauuagcauaggcuccgugucucugaccaucucaacaauuugcuucuuuaugcagaucgccauucucaucacuacggucacccuucacuucaaacaguacgaguuuaacaguccuccaaauaaccagguuaugcugugugaaccgacaauaaucgagagaaauauuacugaaaucguguauuugaccaacacaaccauugagaaggaaaucugccccaaaccugcugaguacaggaauuggagcaagccacagugugggauaacuggauucgcacccuuuuccaaagacaacucuauucgguuaucggccgguggcgauaucuggguaacacgcgagccuuaugugucaugcgacccagauaaguguuaccaauucgcgcuggggcagggaaccacgcuaaauaacguccauagcaauaacacugugcgagaccguacccccuauagaacacuccugaugaaugaacuuggcguuccuuuucaccuggguacuaaacaggugugcauugcuuggaguuccucuagcugucaugaugggaaggccugguugcacgucugcaucaccggagacgauaagaacgcaacagccuccuucaucuacaauggcaggcucguggacucaguaguuaguuggagcaaagagauucugcggacccaggaaucugagugugugugcauaaacggcacguguacugucgugaugacagauggguccgcuucaggaaaggcagacaccaaaauccuguuuauugaggaagguaagaucgugcauacuagcacacucaguggcucugcccaacacgucgaggaaugcuccugcuauccacgcuacccggggguuagaugugugugcagggauaacuggaagggaagcaaucggcccauaguagacauuaacaucaaagaucacucgaucgugucuuccuacgucuguucaggcuuagugggugacaccccucgcaagaaugacaguagcuccucuagccauugccuggauccaaacaaugaggaagggggacacggcguuaaaggcugggcuuucgacgaugggaacgacguguggaugggacgaacgauuaaugagaccucaagacuugguuaugagacauuuaaggucaucgaaggcuggaguaaccccaaauccaaguugcagauuaauaggcaagugauaguagaucguggggaccggagcggauacucuggcaucuucucaguugaggguaaaaguuguauuaaccgcugcuuuuauguggaacugaucagagggaggaaggaggaaacugagguccuauggaccagcaauuccaucguggucuucuguggcacaucuggaacuuacggcaccgggucguggccugauggagccgaccucaaccugaugccaauuuga

SEQ ID NO: 146760 - RNA, 1410 nt, Artificial Sequence; identical to SEQ ID NO: 144162
  derived and/or modified sequence opt3 from neuraminidase__InfluenzaA__AHL95869

SEQ ID NO: 146761 - RNA, 1410 nt, Artificial Sequence
  derived and/or modified sequence opt3 from neuraminidase__InfluenzaA__AHL95881
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaaucuugcugcaggccagucuguggucucggugaaacuggccgggaacagcagcuugugcccuguuaguggaugggcgauauacuccaaggacaauucugugagaauuggcagcaaaggugaugucuucgugaucagggagccauuuauuuccuguucaccguuagaaugccggaccuucuuucugacacagggggcucuacucaacgacaagcauaguaauggaaccaucaaagaucgcagccccuaucgaacucugaugucuuguccuaucggcgagguaccaucccccuacaacucacguuucgaaagcguugccuggagugcaucugccugccacgacggcauuaacuggcuuacaauagggaucuccggaccugauagcggugcuguggcaguccugaaguauaauggcauuaucaccgacacgauaaagucguggagaaacaauauuuugaggacucaagagucugagugugccugcgugaacggguccuguuuuaccaucaugacagauggaccaucagacggccaggcuaguuacaaaaucuuccggauugaaaaggguaaaaucgugaagucagucgagaugaaugcccccaacuaucauuacgaagagugcuccuguuacccugauucuagcgagauuacuugcguuugccgcgacaauuggcacgggucaaacagaccaugggugaguuuuaaucagaaccucgaauaucagauaggauacaucuguuccggcauuuucggcgauaauccgaggcccaacgacaaaaccgggagcugcggaccuguaucuucaaauggugcgaacggcgugaagggguuuaguuucaaguauggaaauggcgucuggaucggucggacaaaaagcaucuccucucgcaagggguuugagaugauuugggauccaaacggcuggaccggaacggacaacaauuucucgauaaaacaagacaucgugggcauuaacgaauggagcggguacuccggaucauuuguucagcaucccgagcugacuggucuggauuguauccgaccuugcuucuggguggaacucauuagaggcaggccaaaggagaauacaaucuggaccagugggucuagcauauccuucuguggagucaacucagacacugugggcuggagcuggcccgauggugcagaguuaccguuuacaaucgacaaauga

SEQ ID NO: 146762 - RNA, 1410 nt, Artificial Sequence
  derived and/or modified sequence opt3 from neuraminidase__InfluenzaA__AHL95892
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgcgcuacgucuguucuggcuuagugggugacacgccucgaaagaaugacuccucaaguagcucccauugccuggauccaaacaaugaggaagggggacacggcguuaaaggcugggcuuucgacgaugggaacgacguguggaugggaagaaccauuaaugagacaucuaggcuugguuaugagacuuuuaaggucaucgaaggcuggagcaaccccaaaucaaaguugcagauuaaucggcaagugauaguagaucguggggaccgcaguggauacuccggcaucuucagcguugaggguaaaucuuguauuaacagaugcuuuuauguggaacugaucagggggcggaaggaggaaaccgagguccuauggacaucaaauaguaucguggucuucuguggcacuagcggaaccuacggcacaggguccuggccugauggagccgaccucaaccugaugccaauuuga

SEQ ID NO: 146763 - RNA, 1410 nt, Artificial Sequence; identical to SEQ ID NO: 144162
  derived and/or modified sequence opt3 from neuraminidase__InfluenzaA__AHL95904

SEQ ID NO: 146764 - RNA, 1410 nt, Artificial Sequence
  derived and/or modified sequence opt3 from neuraminidase__InfluenzaA__AHL95916
augaaccccaaucagaagaucauuaccauaggcagcgugucccugacaaucucuacuauuugcuucuuuaugcagaucgccauucucaucacgaccgucacacuucacuucaaacaguacgagcugaacucaccuccaaauaaccagguuauguugugugaaccgacuauaaucgagagaaauauuaccgaaaucguguauuuaacaaacaccacuauugagaaggaaaucugccccaaaccugcugaguacaggaauuggaguaagccacagugugggauaacaggauuugcacccuucagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugaaugaacugggcguuccuuuccacuuggguaccaaacaggugugcauugcuuggagcaguuccucuugucaugaugggaaggccuggcuccacgucugcaucacaggagacgauaagaacgcaaccgccagcuuuaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcauacaucaaccuuaagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggccuggugggugacacgccucgcaagaaugacucaaguagcuccucucauugccuugauccaaacaaugaggaagggggacacggcguuaaaggcugggcuuuugacgaugggaacgacguguggaugggacgaaccauuaaugagacaagcagauuggguuaugagacuuucaaggucaucgaaggcuggucaaaccccaaaaguaagcugcagauuaauaggcaagugauaguagaucguggggaccgguccggauacagcggcaucuuuucuguugaggguaaaucauguauuaaccgcugcuucuauguggaacuaaucagagggaggaaggaggaaaccgagguccucuggacaaguaauagcaucguggucuuuuguggcacuuccggaaccuacggcacagggucuuggccugauggagccgaccugaaccuuaugccaauuuga

SEQ ID NO: 146765 - RNA, 1410 nt, Artificial Sequence; identical to SEQ ID NO: 145899
  derived and/or modified sequence opt3 from neuraminidase__InfluenzaA__AHL95928

SEQ ID NO: 146766 - RNA, 1410 nt, Artificial Sequence; identical to SEQ ID NO: 145887
  derived and/or modified sequence opt3 from neuraminidase__InfluenzaA__AHL95940

SEQ ID NO: 146767 - RNA, 1410 nt, Artificial Sequence; identical to SEQ ID NO: 144162
  derived and/or modified sequence opt3 from neuraminidase__InfluenzaA__AHL95952

SEQ ID NO: 146768 - RNA, 1410 nt, Artificial Sequence; identical to SEQ ID NO: 144162
  derived and/or modified sequence opt3 from neuraminidase__InfluenzaA__AHL95964

SEQ ID NO: 146769 - RNA, 1410 nt, Artificial Sequence; identical to SEQ ID NO: 144162
  derived and/or modified sequence opt3 from neuraminidase__InfluenzaA__AHL95976

SEQ ID NO: 146770 - RNA, 1410 nt, Artificial Sequence; identical to SEQ ID NO: 144162
  derived and/or modified sequence opt3 from neuraminidase__InfluenzaA__AHL95988

SEQ ID NO: 146771 - RNA, 1410 nt, Artificial Sequence; identical to SEQ ID NO: 144162
  derived and/or modified sequence opt3 from neuraminidase__InfluenzaA__AHL96000

SEQ ID NO: 146772 - RNA, 1410 nt, Artificial Sequence
  derived and/or modified sequence opt3 from neuraminidase__InfluenzaA__AHL96012
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgugccuuaugucucgugcgacccagauaaguguuaccaauucgcgcuggggcagggaacgacucuaaauaacgugcauucaaauaacaccguucgagaccguacacccuauagaacucuccugaugaaugagcuuggcgugccuuuucaccuggguaccaagcaggucugcauugcuuggagcaguuccucuugucaugaugggaaagccugguugcacgugugcaucacaggagacgauaagaacgcaaccgccagcuucaucuacaauggcaggcucguagacuccguugugucauggaguaaagaaauucugcggacgcaggagagcgaaugugucugcauaaacggcacuuguacaguggugaugaccgaugggucugcuuccggaaaggcagacacuaaaauccuguuuauugaggaggguaagaucguccauacaucaacccucagcggcagugcccaacacguugaagagugcucuugcuauccacgcuacccgggggugagauguguaugcagggauaacuggaagggauccaaucggcccauaguggacauuaacaucaaagaucacagcaucgucucgucuuacguguguuccggcuuaguuggugacacgccucgcaagaaugacucaaguagcuccucucauugccuggauccaaacaaugaagaagggggacacggcgugaaaggcugggcuuucgacgaugggaacgacgucuggaugggacgaaccauuaaugagacaagcagacuugguuaugagacuuuuaaggugaucgagggcuggucaaaccccaaaaguaaguugcagauuaauaggcagguaauaguugaucguggggaccgguccggauacagcggcaucuucucuguggaagguaaaucauguauuaaccgcugcuuuuaugucgagcugaucagagggaggaaggaagagaccgaagugcuauggacaaguaauagcaucgucguguucuguggcacuuccggaaccuacggcacagggucuuggccugauggagccgaccucaaccugaugccaauuuga

SEQ ID NO: 146773 - RNA, 1410 nt, Artificial Sequence
  derived and/or modified sequence opt3 from neuraminidase__InfluenzaA__AHL96024
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagaaccugcggacgcaggaaagcgagugugugugcauuaacggcacuuguacagucgugaugaccgaugggucugcuuccggaaaggcagacacuaaaauacuguuuaucgaggaagguaagauugugcauacaucaacccucagcggcagugcccaacacgucgaggaaugcucuugcuauccacgcuacccggggguuagaugugugugcagggauaauuggaagggauccaaccggcccaucguagacauaaauauuaaagaucacagcaucgugucgucuuacgucuguuccggcuuagugggugacacgccucgcaagaacgacucaaguagcuccucucauugccuggauccaaauaacgaggaagggggacacggcguuaaaggcugggcuuucgacgaugggaaugacguguggaugggacgaaccaucaacgagacaagcagacuugguuaugagacuuuuaaggucauugaaggcuggucaaaucccaaaaguaaguugcagaucaacaggcaagugauuguagaucguggggaccgguccggauacagcggcauauucucuguugaggguaaaucauguaucaaucgcugcuuuuauguggaacugauuagagggaggaaggaggaaaccgagguccuauggacaaguaacagcaucguggucuucuguggcacuuccggaaccuacggcacagggucuuggccugauggagccgaccucaaucugaugccaaucuga

SEQ ID NO: 146774 - RNA, 1410 nt, Artificial Sequence; identical to SEQ ID NO: 144162
  derived and/or modified sequence opt3 from neuraminidase__InfluenzaA__AHL96036

SEQ ID NO: 146775 - RNA, 1410 nt, Artificial Sequence; identical to SEQ ID NO: 145405
  derived and/or modified sequence opt3 from neuraminidase__InfluenzaA__AHL96048

SEQ ID NO: 146776 - RNA, 1410 nt, Artificial Sequence; identical to SEQ ID NO: 144162
  derived and/or modified sequence opt3 from neuraminidase__InfluenzaA__AHL96059

SEQ ID NO: 146777 - RNA, 1410 nt, Artificial Sequence; identical to SEQ ID NO: 145899
  derived and/or modified sequence opt3 from neuraminidase__InfluenzaA__AHL96071

SEQ ID NO: 146778 - RNA, 1410 nt, Artificial Sequence; identical to SEQ ID NO: 146740
  derived and/or modified sequence opt3 from neuraminidase__InfluenzaA__AHL96083

SEQ ID NO: 146779 - RNA, 1410 nt, Artificial Sequence; identical to SEQ ID NO: 144162
  derived and/or modified sequence opt3 from neuraminidase__InfluenzaA__AHL96095

SEQ ID NO: 146780 - RNA, 1410 nt, Artificial Sequence
  derived and/or modified sequence opt3 from neuraminidase__InfluenzaA__AHL96107
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacaacucaaguagcucccauugccuggauccaaauaacgaggaagggggacacggcgugaaaggcugggcuuucgacgaugggaaugacguuuggaugggacgaaccauuaacgagacaucuagacuugguuaugagacuuuuaaggugaucgaaggcuggagcaaucccaaaucaaaguugcagauuaacaggcaggucauaguggaucguggggaccggaguggauacuccggcaucuucagcguagaggguaaaucuuguauuaaucgcugcuuuuauguugaacugaucagagggaggaaggaggaaaccgaggugcuauggacaucaaacaguaucgucguguucuguggcacuagcggaaccuacggcacaggguccuggccugauggagccgaccucaaucugaugccaauuuga

SEQ ID NO: 146781 - RNA, 1410 nt, Artificial Sequence; identical to SEQ ID NO: 144162
  derived and/or modified sequence opt3 from neuraminidase__InfluenzaA__AHL96119

SEQ ID NO: 146782 - RNA, 1410 nt, Artificial Sequence; identical to SEQ ID NO: 145899
  derived and/or modified sequence opt3 from neuraminidase__InfluenzaA__AHL96131

SEQ ID NO: 146783 - RNA, 1410 nt, Artificial Sequence; identical to SEQ ID NO: 144162
  derived and/or modified sequence opt3 from neuraminidase__InfluenzaA__AHL96143

SEQ ID NO: 146784 - RNA, 1410 nt, Artificial Sequence; identical to SEQ ID NO: 144162
  derived and/or modified sequence opt3 from neuraminidase__InfluenzaA__AHL96167

SEQ ID NO: 146785 - RNA, 1410 nt, Artificial Sequence; identical to SEQ ID NO: 144162
  derived and/or modified sequence opt3 from neuraminidase__InfluenzaA__AHL96179

SEQ ID NO: 146786 - RNA, 1410 nt, Artificial Sequence
  derived and/or modified sequence opt3 from neuraminidase__InfluenzaA__AHL96191
augaaccccaaucagaagaucauuaccauaggcagcgugucccugacaaucucuacuauuugcuucuuuaugcaaaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauaugcauucaaacaauaccguccgagaucguacacccuauagaacucuccugaugaacgaacuuggcgugccuuuucaccuggguaccaagcagguuugcauugcuuggagcaguuccucuugucaugacgggaaagccugguugcacgugugcaucacaggagaugacaagaaugcaaccgccagcuucaucuacaacggcaggcucgucgauuccgugguaucauggaguaaagagauucugcggacgcaggaaagcgaguguguuugcauaaauggcacuuguacaguggucaugaccgacgggucugcuuccggaaaggcagauacuaaaauccuguuuauugaggaagguaagaucgugcauacaucaacccucagcggcagugcccaacacguggaggaaugcucuugcuauccacgcuacccgggggucagauguguuugcagggacaacuggaagggauccaaccggcccauaguggauauuaauaucaaagaccacagcaucguaucgucuuacguguguuccggcuuagucggugacacgccucgcaagaacgauucaaguagcuccucucauugccuggacccaaauaacgaggaagggggacacggcgugaaaggcugggcuuucgaugacgggaaugauguuuggaugggacgaaccauuaacgagacaagcagacuugguuaugagacuuuuaaggugaucgaaggcuggucaaaucccaaaaguaaguugcagauuaacaggcaggucauaguggaccguggggaucgguccggauacagcggcaucuucucuguagaggguaaaucauguauuaaucgcugcuuuuauguugaacugaucagagggaggaaggaggaaaccgaggugcuauggacaaguaacagcaucgucguguucuguggcacuuccggaaccuacggcacagggucuuggccugacggagccgaucucaaucugaugccaauuuga

SEQ ID NO: 146787 - RNA, 1410 nt, Artificial Sequence; identical to SEQ ID NO: 145887
  derived and/or modified sequence opt3 from neuraminidase__InfluenzaA__AHL96203

SEQ ID NO: 146788 - RNA, 1410 nt, Artificial Sequence; identical to SEQ ID NO: 145899
  derived and/or modified sequence opt3 from neuraminidase__InfluenzaA__AHL96215

SEQ ID NO: 146789 - RNA, 1410 nt, Artificial Sequence; identical to SEQ ID NO: 144162
  derived and/or modified sequence opt3 from neuraminidase__InfluenzaA__AHL96227

SEQ ID NO: 146790 - RNA, 1410 nt, Artificial Sequence; identical to SEQ ID NO: 144162
  derived and/or modified sequence opt3 from neuraminidase__InfluenzaA__AHL96239

SEQ ID NO: 146791 - RNA, 1410 nt, Artificial Sequence; identical to SEQ ID NO: 144162
  derived and/or modified sequence opt3 from neuraminidase__InfluenzaA__AHL96251

SEQ ID NO: 146792 - RNA, 1410 nt, Artificial Sequence; identical to SEQ ID NO: 144162
  derived and/or modified sequence opt3 from neuraminidase__InfluenzaA__AHL96263

SEQ ID NO: 146793 - RNA, 1410 nt, Artificial Sequence; identical to SEQ ID NO: 145943
  derived and/or modified sequence opt3 from neuraminidase__InfluenzaA__AHL96277

SEQ ID NO: 146794 - RNA, 1410 nt, Artificial Sequence
  derived and/or modified sequence opt3 from neuraminidase__InfluenzaA__AHL96308
augaaccccaaucagaagaucauuaccauaggcagcgugucccugacaaucucuacuauuugcuucuuuaugcagaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaaccugcugaguacaggaauuggucaaagccacagugugggauaacaggauuugcacccuucaguaaagacaacagcauucgguuauccgccgguggcgauaucuggguaacccgcgagccuuaugugucuugcgacccagauaaguguuaccaauuugcgcuggggcagggaacgacucuaaauaacguccauucgaauaacaccgugcgagaccguacacccuauagaacucuccugaugucagaacuuggcguuccuuuccaccuggguaccaaacaggugugcauugcuuggagcaguuccucuugucaugaugggaaggccugguugcacgucugcaucacaggagacgauaagaaugcaaccgccagcuuuaucuacaacggcaggcucguggacuccguaguuucauggaguaaagagauucugcggacgcaggaaagcgagugugugugcauaaauggcacuuguacagucgugaugaccgaugggucugcuuccggaaaggcagacacuaaaauccuguucauugaggaagguaagaucgugcauacaucaacccucagcggcagugcccaacacgucgaggaaugcucuugcuauccacgcuacccggggguuagaugugugugcagggauaacuggaagggauccaaccggcccauaguagacauuaauaucaaagaucacagcaucgugucgucuuacgucuguuccggcuuagugggugacacgccucgcaagaacgacucaaguagcuccucucauugccuggauccaaauaacgaggaagggggacacggcguuaaaggcugggcuuuugacgaugggaaugacguguggaugggacgaaccauuaacgagacaagcagacuugguuaugagacuuucaaggucaucgaaggcuggucaaaucccaaaaguaaguugcagauuaacaggcaagugauaguagaucguggggaccgguccggauacagcggcaucuuuucuguugaggguaaaucauguauuaaucgcugcuucuauguggaacugaucagagggaggaaggaggaaaccgagguccuauggacaaguaacagcaucguggucuucuguggcacuuccggaaccuacggcacagggucuuggccugauggagccgaccucaaucugaugccaauuuga

SEQ ID NO: 146795 - RNA, 1410 nt, Artificial Sequence; identical to SEQ ID NO: 145391
  derived and/or modified sequence opt3 from neuraminidase__InfluenzaA__AHL96321

SEQ ID NO: 146796 - RNA, 1410 nt, Artificial Sequence; identical to SEQ ID NO: 144162
  derived and/or modified sequence opt3 from neuraminidase__InfluenzaA__AHL96333

SEQ ID NO: 146797 - RNA, 1410 nt, Artificial Sequence
  derived and/or modified sequence opt3 from neuraminidase__InfluenzaA__AHL96345
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacaacucaaguagcucccauugccuggauccaaauaacgaggaagggggacacggcguuaaaggcugggcuuucgacgaugggaaugacguguggaugggacgaaccauuaacgagacaucuagacuugguuaugagacuuuuaaggucaucgaaggcuggagcaaucccaaaucaaaguugcagauuaacaggcaagugauaguagaucguggggaccggaguggauacuccggcaucuucagcguugaggguaaaucuuguauuaaucgcugcuuuuauguggaacugaucagagggaggaaggaggaaaccgagguccuauggacaucaaacaguaucguggucuucuguggcacuagcggaaccuacggcacaggguccuggccugauggagccgaccucaaucugaugccaauuuga

SEQ ID NO: 146798 - RNA, 1410 nt, Artificial Sequence; identical to SEQ ID NO: 145887
  derived and/or modified sequence opt3 from neuraminidase__InfluenzaA__AHL96357

SEQ ID NO: 146799 - RNA, 1410 nt, Artificial Sequence; identical to SEQ ID NO: 144162
  derived and/or modified sequence opt3 from neuraminidase__InfluenzaA__AHL96369

SEQ ID NO: 146800 - RNA, 1410 nt, Artificial Sequence; identical to SEQ ID NO: 144162
  derived and/or modified sequence opt3 from neuraminidase__InfluenzaA__AHL96381

SEQ ID NO: 146801 - RNA, 1410 nt, Artificial Sequence; identical to SEQ ID NO: 145899
  derived and/or modified sequence opt3 from neuraminidase__InfluenzaA__AHL96393

SEQ ID NO: 146802 - RNA, 1410 nt, Artificial Sequence
  derived and/or modified sequence opt3 from neuraminidase__InfluenzaA__AHL96405
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggggccaaacaaugaggaaggaggccacggcguuaaagggugggcuuucgaugacggaaacgauguguggaugggucgaaccauuaaugagacaagcagacuuggcuaugagacuuuuaaggucaucgaaggguggucaaaccccaaaaguaaguugcagauuaauaggcaagugauaguagaccggggagaucguuccggcuacagcgguaucuucucuguugaggggaaaucauguauuaaccgcugcuuuuauguggaacugaucagaggcaggaaggaggaaaccgagguccuauggacaaguaauagcaucguggucuucuguggaacuuccggcaccuacgggacaggaucuuggccugacggugccgaucucaaccugaugccaauuuga

SEQ ID NO: 146803 - RNA, 1410 nt, Artificial Sequence; identical to SEQ ID NO: 144162
  derived and/or modified sequence opt3 from neuraminidase__InfluenzaA__AHL96417

SEQ ID NO: 146804 - RNA, 1410 nt, Artificial Sequence; identical to SEQ ID NO: 144162
  derived and/or modified sequence opt3 from neuraminidase__InfluenzaA__AHL96429

SEQ ID NO: 146805 - RNA, 1410 nt, Artificial Sequence
  derived and/or modified sequence opt3 from neuraminidase__InfluenzaA__AHL96441
augaaccccaaucagaagaucauuaccauaggcagcgugucccugacaaucucuacuauuugcuucuuuaugcaaaucgccauucucaucacgaccgucacacuucacuucaaacauuacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaguucgcgcugggccaagggacgacucuaaauaacguccacucaaauaacaccgugcgagaucguacacccuauagaacucuccugaugaaugaacuuggaguuccuuuucaucugggcaccaaacaggugugcauugcuuggagcaguuccucuugucacgacgguaaggccugguugcaugucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcacacaucaacccucagcgguagugcccagcacgucgaggaaugcucuugcuauccacgcuacccgggcguuagaugugugugcagggacaacuggaagggguccaaucggcccauaguagauauuaacaucaaagaccauagcaucgugucgcgcuacgucuguucuggauuagugggcgacacgccucgaaagaaugauuccucaaguagcucccacugccugaacccaaauaacgaggaaggugggcauggaguuaaaggcugggcuuucgacgauggcaaugacguguggauggggagaaccauuaacgagacaucuaggcuuggauaugagacuuuuaaggucaucgaagguuggagcaaucccaaaucaaaguugcaaauuaaccggcagauaaucguggaucguggcgaccgcaguggguacuccggaauuuucagcguagagggcaaaucuuguaucaauagaugcuuuuauguugaacugaucaggggucggaaggaggaaaccgaggugcuauggacaucaaacaguauugucguguucugugggacuagcggcaccuacggaacaggcuccuggccugauggggccgaccucaaucugaugccaauauga

SEQ ID NO: 146806 - RNA, 1410 nt, Artificial Sequence; identical to SEQ ID NO: 144162
  derived and/or modified sequence opt3 from neuraminidase__InfluenzaA__AHL96453

SEQ ID NO: 146807 - RNA, 1410 nt, Artificial Sequence; identical to SEQ ID NO: 144162
  derived and/or modified sequence opt3 from neuraminidase__InfluenzaA__AHL96465

SEQ ID NO: 146808 - RNA, 1410 nt, Artificial Sequence
  derived and/or modified sequence opt3 from neuraminidase__InfluenzaA__AHL96477
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagauuacuugcguuugccgcgacaauuggcacgggucaaacagaccaugggugaguuucaaucagaacuuggaauaucagauaggauacaucuguuccggcauuuuuggcgauaauccgaggcccaacgacaaaaccgggagcugcggaccuguaucuucaaauggugcgaacggcgugaagggguucaguuuuaaguauggaaauggcgucuggaucggucggacaaaaagcaucuccucucgcaagggguucgagaugauuugggauccaaacggcuggaccggaacggacaacaauuuuucgauaaaacaagacaucgugggcauuaacgaauggagcggguacuccggaucauucguucagcaucccgagcucacuggucuggauuguauccgaccuugcuucuggguggaacugauuagaggcaggccaaaggagaauacaaucuggaccagugggucuagcauauccuuuuguggagucaacucagacacugugggcuggagcuggcccgauggugcagagcucccguucacaaucgacaaauga

SEQ ID NO: 146809 - RNA, 1410 nt, Artificial Sequence; identical to SEQ ID NO: 145899
  derived and/or modified sequence opt3 from neuraminidase__InfluenzaA__AHL96488

SEQ ID NO: 146810 - RNA, 1410 nt, Artificial Sequence; identical to SEQ ID NO: 144162
  derived and/or modified sequence opt3 from neuraminidase__InfluenzaA__AHL96500

SEQ ID NO: 146811 - RNA, 1410 nt, Artificial Sequence; identical to SEQ ID NO: 144162
  derived and/or modified sequence opt3 from neuraminidase__InfluenzaA__AHL96512

SEQ ID NO: 146812 - RNA, 1410 nt, Artificial Sequence; identical to SEQ ID NO: 145391
  derived and/or modified sequence opt3 from neuraminidase__InfluenzaA__AHL96524

SEQ ID NO: 146813 - RNA, 1410 nt, Artificial Sequence
  derived and/or modified sequence opt3 from neuraminidase__InfluenzaA__AHL96536
augaaccccaaucagaagaucauuaccauaggcagcgugucccugacaaucucuacuauuugcuucuuuacgcagaucgccauucucaucaccacagucacucuucacuucaaacaguacgaguuuaacucaccuccaaauaaccagguuaugcugugugaaccgaccauaaucgagagaaauauuacagaaaucguguauuugaccaacacuacaauugagaaggaaaucugccccaaaccugcugaguacaggaauuggaguaagccacagugugggauaaccggauucgcacccuuuagcaaagacaacuccauucgguuaucugccgguggcgauaucuggguaacgcgcgagccuuaugugucgugcgacccagauaaguguuaccaauucgcgcuggggcagggaacuaccauuaauaacguccauucaaauaacacagugcgagaccguacucccuauagaacccuacucaugaaugaacugggcguuccuuuucaccuugguacaaaacaggugugcaucgcuuggagcaguuccucuugucaugaugggaaggccuggcugcacgucugcaucaccggagacgauaagaacgcaacggccagcuucauuuacaauggcagguugguggacuccguaguuucauggaguaaagagauacuccggacucaggaaagcgagugugugugcaucaacggcacauguaccgucgugaugacugaugggucugcuuccggaaaggcagacacaaaaauucuguuuaucgaggaagguaagauagugcauaccucaacgcugagcggcagugcccaacacgucgaggaaugcucuugcuauccacgcuacccggggguuagaugugugugcagggauaacuggaagggauccaaucggcccauuguagacaucaacaucaaagaucacagcauugugucgucuuacgucuguuccggccucgugggugacaccccucgcaagaaugacucaaguagcuccucucauugcuuagauccaaacaaugaggaagggggacacggcguuaaaggcugggcuuucgacgaugggaacgacguguggaugggacgaacaaucaaugagacuagcagacuggguuaugagaccuuuaaggucauugaaggcuggucaaaccccaaaaguaaacuucagauaaauaggcaagugaucguagaucguggggaccgguccggauacagcggcauuuucucuguugaggguaagucauguaucaaccgcugcuuuuauguggaauugaucagagggaggaaggaggaaacagagguccuguggaccaguaauagcauuguggucuucuguggcacuuccggaacauacggcaccgggucuuggccugauggagccgaccuaaaccucaugccaauauga

SEQ ID NO: 146814 - RNA, 1410 nt, Artificial Sequence; identical to SEQ ID NO: 145899
  derived and/or modified sequence opt3 from neuraminidase__InfluenzaA__AHL96548

SEQ ID NO: 146815 - RNA, 1410 nt, Artificial Sequence
  derived and/or modified sequence opt3 from neuraminidase__InfluenzaA__AHL96560
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggaacgcuucuggaaaggcagacacuaaaauccuguuuauugaggaagguaagaucgugcauacauccacccucucaggcagcgcccaacacgucgaggaaugcaguugcuauccacgcuacccggggguuagaugugugugcagggauaauuggaagggaucuaaccggcccauaguagacauuaauaucaaagaucacuccaucgugagcucguacgucuguucuggcuuagugggugacacgccucgcaagaacgacuccucaaguagcucccauugccuggauccaaauaacgaggaagggggacacggcguuaaaggcugggcuuucgacgaugggaaugacguguggaugggacgaaccauuaacgagacaucuagacuugguuaugagacuuuuaaggucaucgaaggcuggagcaaucccaaaucaaaguugcagauuaacaggcaagugauaguagaucguggggaccggaguggauacuccggcaucuucagcguugaggguaaaucuuguauuaaucgcugcuuuuauguggaacugaucagagggaggaaggaggaaaccgagguccuauggacaucaaacaguaucguggucuucuguggcacuagcggaaccuacggcacaggguccuggccugauggagccgaccucaaucugaugccaauuuga

SEQ ID NO: 146816 - RNA, 1410 nt, Artificial Sequence; identical to SEQ ID NO: 145373
  derived and/or modified sequence opt3 from neuraminidase__InfluenzaA__AHL96572

SEQ ID NO: 146817 - RNA, 1410 nt, Artificial Sequence; identical to SEQ ID NO: 146808
  derived and/or modified sequence opt3 from neuraminidase__InfluenzaA__AHL96584

SEQ ID NO: 146818 - RNA, 1410 nt, Artificial Sequence
  derived and/or modified sequence opt3 from neuraminidase__InfluenzaA__AHL96595
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugagucaaaaaguuguauuaaccgcugcuuuuauguggaacugaucagagguaggaaggaggaaaccgagguccuauggacaagcaauuccaucguggucuucugugggacuucuggcaccuacggaacaggcucguggccugauggggccgaccucaaccugaugccaauuuga

SEQ ID NO: 146819 - RNA, 1410 nt, Artificial Sequence; identical to SEQ ID NO: 144162
  derived and/or modified sequence opt3 from neuraminidase__InfluenzaA__AHL96607

SEQ ID NO: 146820 - RNA, 1410 nt, Artificial Sequence
  derived and/or modified sequence opt3 from neuraminidase__InfluenzaA__AHL96631
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacccgcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacaugcauucaaauaacaccguccgagaccguacaccauauagaacucugcuuaugaaugaacugggcgugcccuuucacuuggguaccaagcagguuugcauugcuuggagcaguuccucuugucaugaugggaaagccuggcuccacgugugcaucacaggagacgauaagaacgcaaccgccagcuucaucuacaauggcaggcuggucgacuccgugguaucauggaguaaagagauucugcggacgcaggaaagcgaguguguuugcauaaacggcacuuguacaguggucaugaccgaugggucugcuuccggaaaggcagacacuaaaauccucuuuauugaggaagguaagaucgugcauacaucaaccuuaagcggcagugcccaacacguggaggaaugcucuugcuauccucgcuacccaggggucagauguguuugcagggauaacuggaagggauccaaucggccgauaguggacauuaacaucaaagaucacagcaucguaucgucuuacguguguuccggccuggucggugacacgccccgcaagaaugacucaaguagcuccucucauugccuugauccuaacaaugaggaagggggacacggcgugaaaggcugggcuuucgacgaugggaacgacguuuggaugggacgaaccauuaaugagacaagcagauuggguuaugagacuuuuaaggugaucgaaggcuggucaaacccaaaaaguaagcugcagauuaauaggcaggucauaguggaucguggggaccgguccggauacagcggcaucuucucuguagaggguaaaucauguauuaaccgcugcuuuuauguugaacuaaucagagggaggaaggaggaaaccgaggugcucuggacaaguaauagcaucgucguguucuguggcacuuccggaaccuacggcacagggucuuggcccgauggagccgaccugaaccuuaugccuauuuga

SEQ ID NO: 146821 - RNA, 1410 nt, Artificial Sequence; identical to SEQ ID NO: 145899
  derived and/or modified sequence opt3 from neuraminidase__InfluenzaA__AHL96643

SEQ ID NO: 146822 - RNA, 1410 nt, Artificial Sequence; identical to SEQ ID NO: 144162
  derived and/or modified sequence opt3 from neuraminidase__InfluenzaA__AHL96655

SEQ ID NO: 146823 - RNA, 1410 nt, Artificial Sequence; identical to SEQ ID NO: 144162
  derived and/or modified sequence opt3 from neuraminidase__InfluenzaA__AHL96667

SEQ ID NO: 146824 - RNA, 1410 nt, Artificial Sequence; identical to SEQ ID NO: 144162
  derived and/or modified sequence opt3 from neuraminidase__InfluenzaA__AHL96679

SEQ ID NO: 146825 - RNA, 1410 nt, Artificial Sequence; identical to SEQ ID NO: 144162
  derived and/or modified sequence opt3 from neuraminidase__InfluenzaA__AHL96691

SEQ ID NO: 146826 - RNA, 1410 nt, Artificial Sequence; identical to SEQ ID NO: 144162
  derived and/or modified sequence opt3 from neuraminidase__InfluenzaA__AHL96703

SEQ ID NO: 146827 - RNA, 1410 nt, Artificial Sequence; identical to SEQ ID NO: 145887
  derived and/or modified sequence opt3 from neuraminidase__InfluenzaA__AHL96763

SEQ ID NO: 146828 - RNA, 1410 nt, Artificial Sequence; identical to SEQ ID NO: 146740
  derived and/or modified sequence opt3 from neuraminidase__InfluenzaA__AHL96787

SEQ ID NO: 146829 - RNA, 1410 nt, Artificial Sequence
  derived and/or modified sequence opt3 from neuraminidase__InfluenzaA__AHL96799
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaugagaccgaaguccuauggacaaguaauagcaucguggucuucuguggcacuuccggaaccuacggcacagggucuuggccugacggagccgaucucaaccugaugccaauuuga

SEQ ID NO: 146830 - RNA, 1410 nt, Artificial Sequence; identical to SEQ ID NO: 145899
  derived and/or modified sequence opt3 from neuraminidase__InfluenzaA__AHL96811

SEQ ID NO: 146831 - RNA, 1410 nt, Artificial Sequence; identical to SEQ ID NO: 145899
  derived and/or modified sequence opt3 from neuraminidase__InfluenzaA__AHL96823

SEQ ID NO: 146832 - RNA, 1410 nt, Artificial Sequence; identical to SEQ ID NO: 144162
  derived and/or modified sequence opt3 from neuraminidase__InfluenzaA__AHL96847

SEQ ID NO: 146833 - RNA, 1410 nt, Artificial Sequence
  derived and/or modified sequence opt3 from neuraminidase__InfluenzaA__AHL96859
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuauguaucgugcgacccagauaaguguuaccaauucgcgcuggggcagggaacgacucuaaauaacgugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagccgaccucaaccugaugccaauuuga

SEQ ID NO: 146834 - RNA, 1410 nt, Artificial Sequence
  derived and/or modified sequence opt3 from neuraminidase__InfluenzaA__AHL96871
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaguggagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagguccugcggacgcaggaaagcgagugugugugcaucaacggcacuugugcuguggucaugacagaugggucugcauccggaaaggccgacaccaaaauucuguuuauagaggaagguaagaucguucauacuucaacacucagcggcagugcucaacacguggaggaaugcucuugcuauccacgcuacccggggguaagaugugugugcagggauaacuggaagggauccaaucggcccauugucgacaucaacauaaaagaucacagcauugugucgucuuacguuuguuccggcuuagugggugacaccccucgcaagaaugaccgaucaaguagcucccauugccuggauccaaacaaugaggaagggggacacggcgucaaaggcugggccuucgacgaugggaacgacguguggaugggaagaacgaucaaugagaccucuaggcuugguuaugagacauuuaagguaaucgaaggcuggagcaaccccaaaucaaaguugcagauuaaucggcagguuaucguggaucguggggaccgcaguggauacuccggcauuuucagcgucgaggguaaaucuuguauaaacagaugcuuuuauguggaacugaucagggggcggaaggaggaaacugagguccuauggaccucaaauaguauugugguuuucuguggcacaagcggaacuuacggcaccggguccuggccugauggagcggaccucaaccugaugccaaucuga

SEQ ID NO: 146835 - RNA, 1410 nt, Artificial Sequence
  derived and/or modified sequence opt3 from neuraminidase__InfluenzaA__AHL96883
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaagugcugaguacaggaauuggagcaagccucagugugggauaacaggauucgcaccauuuuccaaagacaacucuauucgguuaucggccgguggcgauaucuggguaacccgcgagcccuaugugucaugcgacccugauaaguguuaccaauucgcgcuggggcagggaacgacucuaaauaacaugcauagcaauaacaccguccgagaccguacaccauauagaacucuccugaugaaugaacuuggcgugcccuuucaccuggguaccaagcagguuugcauugcuuggaguuccucuagcugucaugaugggaaagccugguugcacgugugcaucacaggagacgauaagaacgcaaccgccuccuucaucuacaauggcaggcucgucgacucagugguaaguuggagcaaagagauucugcggacgcaggaaucugaguguguuugcauaaacggcacuuguacaguggucaugaccgauggguccgcuucaggaaaggcagacacuaaaauccuguuuauugaggaagguaagaucgugcauacaagcacccucaguggcucugcccaacacguggaggaaugcuccugcuauccucgcuacccaggggucagauguguuugcagggauaacuggaagggaagcaaucggccgauaguggacauuaacaucaaagaucacucgaucguaucuuccuacguguguucaggcuuagucggugacacgccccgcaagaaugacaguagcuccucuagccauugccuggauccuaacaaugaggaagggggacacggcgugaaaggcugggcuuucgacgaugggaacgacguuuggaugggacgaaccauuaaugagacaucaagacuugguuaugagacuuuuaaggugaucgaaggcuggaguaacccaaaauccaaguugcagauuaauaggcaggucauaguggaucguggggaccggagcggauacucuggcaucuucucaguagaggguaaaaguuguauuaaccgcugcuuuuauguugaacugaucagagggaggaaggaggaaaccgaggugcuauggacaagcaauuccaucgucguguucuguggcacuucuggaaccuacggcacagggucguggcccgauggagccgaccucaaccugaugccuauuuga

SEQ ID NO: 146836 - RNA, 1410 nt, Artificial Sequence; identical to SEQ ID NO: 145887
  derived and/or modified sequence opt3 from neuraminidase__InfluenzaA__AHL96895

SEQ ID NO: 146837 - RNA, 1410 nt, Artificial Sequence
  derived and/or modified sequence opt3 from neuraminidase__InfluenzaA__AHL96907
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaguggagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagguccugcggacgcaggaaagcgagugugugugcaucaacggcacuugugcuguggucaugacagaugggucugcauccggaaaggccgacaccaaaauucuguuuauagaggaagguaagaucguucauacuucaacacucagcggcagugcucaacacguggaggaaugcucuugcuauccacgcuacccggggguaagaugugugugcagggauaacuggaagggauccaaucggcccauugucgacaucaacauaaaagaucacagcauugugucgucuuacguuuguuccggcuuagugggugacaccccucgcaagaaugacucaaguagcuccucucauugccuggauccaaacaaugaggaagggggacacggcgucaaaggcugggccuucgacgaugggaacgacguguggaugggacgaacgaucaaugagaccagcagacuugguuaugagacauuuaagguaaucgaaggcuggucaaaccccaaaaguaaguugcagauuaauaggcagguuaucguggaucguggggaccgguccggauacagcggcauuuucucugucgaggguaaaucauguauaaaccgcugcuuuuauguggaacugaucagagggaggaaggaggaaacugagguccuauggaccaguaauagcauugugguuuucuguggcacauccggaacuuacggcaccgggucuuggccugauggagcggaccucaaccugaugccaaucuga

SEQ ID NO: 146838 - RNA, 1410 nt, Artificial Sequence; identical to SEQ ID NO: 145899
  derived and/or modified sequence opt3 from neuraminidase__InfluenzaA__AHL96919

SEQ ID NO: 146839 - RNA, 1410 nt, Artificial Sequence; identical to SEQ ID NO: 145899
  derived and/or modified sequence opt3 from neuraminidase__InfluenzaA__AHL96931

SEQ ID NO: 146840 - RNA, 1410 nt, Artificial Sequence; identical to SEQ ID NO: 145899
  derived and/or modified sequence opt3 from neuraminidase__InfluenzaA__AHL96943

SEQ ID NO: 146841 - RNA, 1410 nt, Artificial Sequence
  derived and/or modified sequence opt3 from neuraminidase__InfluenzaA__AHL96955
augaaccccaaucagaagaucauuaccauaggcagcgugucccugacaaucucuacuauuugcuucuuuaugcagaucgccauucucaucacgaccgucacacuucacuucaaacaguacgaguuuaacucaccuaguaauaaccagguuaugcugugugaaccaacuauaaucgagagaaauauuaccgaaaucguguauuugacaaacaccacuauugagaaggaaaucugcccgaaacccgcugaguacaggaauuggagcaagccucagugugggauaacaggauucgcaccauuuuccaaagacaacucuauucgguuaucggccgguggcaauaucuggguaacccgcgagcccuaugugucaugcgauccugacaaguguuaccaauucgcgcuggggcagggaacgacucuaaacaauguccauagcaacaauaccgugcgagaucguacaccauauagaacucuccugaugaacgaacuuggcguucccuuucaccuggguaccaaacaggugugcauugcuuggaguuccucuagcugucaugacgggaaggccugguugcacgucugcaucacaggagaugacaagaaugcaaccgccuccuucaucuacaacggcaggcucguggauucaguaguuaguuggagcaaagagauucugcggacgcaggaaucugagugugugugcauaaacggcacuuguacagucgugaugaccgacggguccgcuucaggaaaggcagauacuaaaauccuguuuauugaggaagguaagaucgugcauacaagcacccucaguggcucugcccaacacgucgaggaaugcuccugcuauccucgcuacccagggguuagaugugugugcagggacaauuggaagggaagcaaccggccgauaguagauauuaauaucaaagaccacucgaucgugucuuccuacgucuguucaggcuuagugggugauacgccccgcaagaacgacaguagcuccucuagccauugccuggacccuaauaacgaggaagggggacacggcguuaaaggcugggcuuucgaugacgggaaugauguguggaugggacgaaccauuaacgagacaucaagacuugguuaugagacuuuuaaggucaucgaaggcuggaguaauccaaaauccaaguugcagauuaacaggcaagugauaguagaccguggggaucggagcggauacucuggcaucuucucaguugaggguaaaaguuguauuaaucgcugcuuuuauguggaacugaucagagggaggaaggaggaaaccgagguccuauggacaagcaacuccaucguggucuucuguggcacuucuggaaccuacggcacagggucguggcccgacggagccgaucucaaucugaugccuauuuga

SEQ ID NO: 146842 - RNA, 1410 nt, Artificial Sequence; identical to SEQ ID NO: 146740
  derived and/or modified sequence opt3 from neuraminidase__InfluenzaA__AHL96967

SEQ ID NO: 146843 - RNA, 1410 nt, Artificial Sequence
  derived and/or modified sequence opt3 from neuraminidase__InfluenzaA__AHL96979
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacaugcauucaaauaacaccguccgagaucguacacccuauagaacucuccugaugaaugaacuuggagugccuuuucaccugggcaccaagcagguuugcauugcuuggagcaguuccucuugucaugacgguaaagccugguugcacgugugcaucacaggggaugacaagaacgcaaccgccagcuucaucuacaauggaaggcucgucgauuccgugguaucauggaguaaagagauucugcggacgcaggaaagcgaguguguuugcauaaacggcacuuguacaguggucaugaccgacggcucugcuuccgggaaggcagauacuaaaauccuguuuauugaggaaggaaagaucgugcauacaucaacccucagcgguagugcccaacacguggaggaaugcucuugcuauccacgcuacccgggcgucagauguguuugcagggacaacuggaagggguccaaucggcccauaguggauauuaacaucaaagaccacagcaucguaucgucuuacguguguuccggauuagucggcgacacgccucgcaagaaugauucaaguagcuccucucauugccuggacccaaacaaugaggaaggugggcacggagugaaaggcugggcuuucgaugacggcaacgauguuuggauggggcgaaccauuaaugagacaagcagacuuggauaugagacuuuuaaggugaucgaagguuggucaaaccccaaaaguaaguugcagauuaauaggcaggucauaguggaccggggcgaucguuccggguacagcggaaucuucucuguagagggcaaaucauguauuaaccgcugcuuuuauguugaacugaucagagguaggaaggaggaaaccgaggugcuauggacaaguaauagcaucgucguguucugugggacuuccggcaccuacggaacaggcucuuggccugacggggccgaucucaacauuaugccaauauga

SEQ ID NO: 146844 - RNA, 1410 nt, Artificial Sequence; identical to SEQ ID NO: 145899
  derived and/or modified sequence opt3 from neuraminidase__InfluenzaA__AHL96991

SEQ ID NO: 146845 - RNA, 1410 nt, Artificial Sequence; identical to SEQ ID NO: 144162
  derived and/or modified sequence opt3 from neuraminidase__InfluenzaA__AHL97003

SEQ ID NO: 146846 - RNA, 1410 nt, Artificial Sequence
  derived and/or modified sequence opt3 from neuraminidase__InfluenzaA__AHL97015
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcagauaaucguggaucguggggaccgguccggauacagcggcauuuucucuguagaggguaaaucauguaucaaccgcugcuuuuauguugaacugaucagagggaggaaggaggaaaccgaggugcuauggacaaguaauagcauugucguguucuguggcacuuccggaaccuacggcacagggucuuggccugauggagccgaccucaaccugaugccaauauga

SEQ ID NO: 146847 - RNA, 1410 nt, Artificial Sequence; identical to SEQ ID NO: 144162
  derived and/or modified sequence opt3 from neuraminidase__InfluenzaA__AHL97027

SEQ ID NO: 146848 - RNA, 1410 nt, Artificial Sequence
  derived and/or modified sequence opt3 from neuraminidase__InfluenzaA__AHL97039
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggaacgcuucuggaaaggcagacacuaaaauccuguuuauugaggaagguaagaucgugcauacauccacccucucaggcagcgcccaacacgucgaggaaugcaguugcuauccacgcuacccggggguuagaugugugugcagggauaauuggaagggaucuaaccggcccauaguagacauuaauaucaaagauuacuccaucgugagcucguaugucuguucuggcuuagugggugacacgccucgcaagaacgacuccucaaguagcucccacugccuggauccaaauaacgaggaagggggacauggcguuaaaggcugggcuuucgacgaugggaaugacguguggaugggacgaaccauuaacgagacaucuagacuugguuacgagacuuuuaaggucaucgaaggcuggagcaaucccaaaucaaaguugcagauuaacaggcaagugauaguagaucguggggaccggaguggauauuccggcaucuucagcguugaggguaaaucuuguauuaaucgcugcuuuuacguggaacugaucagagggaggaaggaggaaaccgagguccuauggacaucaaacaguaucguggucuucuguggcacuagcggaaccuauggcacaggguccuggccugauggagccgaccucaaucugaugccaauuuga

SEQ ID NO: 146849 - RNA, 1410 nt, Artificial Sequence; identical to SEQ ID NO: 144162
  derived and/or modified sequence opt3 from neuraminidase__InfluenzaA__AHL97051

SEQ ID NO: 146850 - RNA, 1410 nt, Artificial Sequence
  derived and/or modified sequence opt3 from neuraminidase__InfluenzaA__AHL97063
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggggccaaacaaugaggaaggaggccacggcguuaaagggugggcuuucgaugacggaaacgauguguggaugggucgaaccauuaaugagacaagcagacuuggcuaugagacuuuuaaggucaucgacggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 146851 - RNA, 1410 nt, Artificial Sequence; identical to SEQ ID NO: 144162
  derived and/or modified sequence opt3 from neuraminidase__InfluenzaA__AHL97075

SEQ ID NO: 146852 - RNA, 1410 nt, Artificial Sequence; identical to SEQ ID NO: 145887
  derived and/or modified sequence opt3 from neuraminidase__InfluenzaA__AHL97087

SEQ ID NO: 146853 - RNA, 1410 nt, Artificial Sequence; identical to SEQ ID NO: 145391
  derived and/or modified sequence opt3 from neuraminidase__InfluenzaA__AHL97099

SEQ ID NO: 146854 - RNA, 1410 nt, Artificial Sequence; identical to SEQ ID NO: 144162
  derived and/or modified sequence opt3 from neuraminidase__InfluenzaA__AHL97111

SEQ ID NO: 146855 - RNA, 1410 nt, Artificial Sequence
  derived and/or modified sequence opt3 from neuraminidase__InfluenzaA__AHL97123
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgccgaaacgauucaaguagcuccucucauugccuggacccaaauaacgaggaagggggacacggcguuaagggcugggcuuucgaugacgggaaugauguguggaugggaagaaccauuaacgagacaagcaggcuugguuaugagacuuuuaaagucaucgaaggcuggucaaaucccaagaguaaauugcagauuaaccggcaagugauaguagaccguggggaucgcuccggauacagcggcaucuucucuguugaggguaagucauguauuaauagaugcuuuuauguggaacugaucagggggcggaaagaggaaaccgagguccuauggacaaguaacagcaucguggucuucuguggcacuuccggaaccuacggcacagggucuuggccugacggagccgaucucaaucugaugccaauuuga

SEQ ID NO: 146856 - RNA, 1410 nt, Artificial Sequence; identical to SEQ ID NO: 145919
  derived and/or modified sequence opt3 from neuraminidase__InfluenzaA__AHL97135

SEQ ID NO: 146857 - RNA, 1410 nt, Artificial Sequence
  derived and/or modified sequence opt3 from neuraminidase__InfluenzaA__AHL97147
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggcggggauccaaucgccccauaguagacauuaacaucaaggaucacagcaucgugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggaagaaccauuaaugagacaagcaggcuugguuaugagacuuuuaaagucaucgaaggcuggucaaaccccaagaguaaauugcagauuaaucgacaggugauaguagaucguggggaccgcuccggauacagcggcaucuucucuguugaggguaagucauguauuaacagaugcuuuuauguggaacugaucagggggcggaaagaggaaaccgagguccuauggacaaguaauagcaucguggucuucuguggcacuuccggaaccuacggcacagggucuuggccugauggagccgaccucaaccugaugccaauuuga

SEQ ID NO: 146858 - RNA, 1410 nt, Artificial Sequence; identical to SEQ ID NO: 144162
  derived and/or modified sequence opt3 from neuraminidase__InfluenzaA__AHL97159

SEQ ID NO: 146859 - RNA, 1410 nt, Artificial Sequence; identical to SEQ ID NO: 144162
  derived and/or modified sequence opt3 from neuraminidase__InfluenzaA__AHL97171

SEQ ID NO: 146860 - RNA, 1410 nt, Artificial Sequence; identical to SEQ ID NO: 144162
  derived and/or modified sequence opt3 from neuraminidase__InfluenzaA__AHL97183

SEQ ID NO: 146861 - RNA, 1410 nt, Artificial Sequence; identical to SEQ ID NO: 144162
  derived and/or modified sequence opt3 from neuraminidase__InfluenzaA__AHL97195

SEQ ID NO: 146862 - RNA, 1410 nt, Artificial Sequence; identical to SEQ ID NO: 144162
  derived and/or modified sequence opt3 from neuraminidase__InfluenzaA__AHL97207

SEQ ID NO: 146863 - RNA, 1410 nt, Artificial Sequence; identical to SEQ ID NO: 144162
  derived and/or modified sequence opt3 from neuraminidase__InfluenzaA__AHL97219

SEQ ID NO: 146864 - RNA, 1410 nt, Artificial Sequence
  derived and/or modified sequence opt3 from neuraminidase__InfluenzaA__AHL97231
augaaccccaaucagaagaucauuaccauaggcagcgugucccugacaaucucuacuauuugcuucuuuaugcagaucgccauucucaucacgaccgucacacuucacuucaaacaguacgacuuuaacucaccuccaaauaaccagguuaugcugugugagccgacuauaaucgaaagaaauauuaccgagaucguguauuugacaaacaccacuauugaaaaggagaucugccccaaaccugcugaauacaggaauuggaguaagccacagugugggauaacaggauucgcacccuuuagcaaagauaacuccauucgguuaucugccgguggcgacaucuggguaacccgcgagccuuaugugucgugcgauccagacaaguguuaccaauucgcgcuggggcagggaacgacucuaaauaacguccauucaaauaacaccgugcgagaucguacacccuauagaacucuccugaugaaugagcuuggcguuccuuuucaccuggguaccaaacaggugugcauugcuuggagcaguuccucuugucaugacgggaaggccugguugcacgucugcaucacaggagaugacaagaacgcaaccgccagcuucaucuacaauggcaggcucguggauuccguaguuucauggaguaaagaaauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcgugaucucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucggcggguggucaaaccccaaaaguaaguugcagauuaauaggcaagugauaguagaccggggagaucguuccggcuacagcgguaucuucucuguugaggggaaaucauguauuaaccgcugcuuuuauguggaacugaucagaggcaggaaggaggaaaccgagguccuauggacaaguaauagcaucguggucuucuguggaacuuccggcaccuacgggacaggaucuuggccugacggugccgaucucaaccugaugccaauuuga

SEQ ID NO: 146865 - RNA, 1410 nt, Artificial Sequence
  derived and/or modified sequence opt3 from neuraminidase__InfluenzaA__AHL97243
augaaccccaaucagaagaucauuaccauaggcagcgugucccugacaaucucuacuauuugcuucuuuaugcagaucgccauucucaucacgaccgucacacuuaacuucaaacaguacgaguuuaauucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagacaauuccauucgguuaucugccgguggcgauaucuggguaacccgcgagccuuaugugucgugcgacccagauaaguguuaccaauucgcgcuggggcagggaacgacucuaaacaauguccacucaaacaauaccgugcgagaccguacacccuauagaacucuccugaugaacgaacuuggcguuccuuuucaucuggguaccaaacaggugugcauugcuuggagcaguuccucuugucacgaugggaaggccugguugcaugucugcaucacaggagacgauaagaaugcaaccgccagcuucaucuacaacggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcagugcccaacaugucgaggaaugcucuugcuauccacgcuacccggggguuagaugugugugcagggauaauuggaagggauccaaccggcccauaguagacauuaauaucaaagaucacagcaucgugucgucuuacgucuguuccggcuuagugggugacacgccucgcaagaacgacucaaguagcuccucucacugccuggauccaaauaacgaggaagggggacauggcguuaaaggcugggcuuucgacgaugggaaugacguguggaugggacgaaccauuaacgagacaagcagacuugguuaugagacuuuuaaggucaucgaaggcuggucaaaucccaaaaguaaguugcagauuaacaggcaagugauaguagaucguggggaccgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugauggagccgaccucaaucugaugccaauuuga

SEQ ID NO: 146866 - RNA, 1410 nt, Artificial Sequence; identical to SEQ ID NO: 145391
  derived and/or modified sequence opt3 from neuraminidase__InfluenzaA__AHL97255

SEQ ID NO: 146867 - RNA, 1410 nt, Artificial Sequence
  derived and/or modified sequence opt3 from neuraminidase__InfluenzaA__AHL97267
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgcucgagaccguacacccuauagaacucuccugaugaaugaacuuggcgugccuuuucaccuggguaccaagcagguuugcauugccuggagcaguuccucuugucaugaugggaaagcaugguugcacgugugcaucacaggagacgauaagaacgccaccgcuagcuucaucuacaauggcaggcucgucgacuccgugguaucauggaguaaagagauucugcggacgcaggaaagcgaguguguuugcauaaacggcacuuguacaguggucaugaccgaugggucugcauccggaaaggccgacacuaaaauccuguuuauugaggaagguaagaucgugcauacaucaacccucagcggcagugcucaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucauucaguagcucccauugccuggauccaaacaaugaggaagggggacacggcgugaaaggcugggccuuugacgaugggaacgacguuuggaugggacgaaccauuaaugagacaucuagacuugguuaugagacuuucaaggugaucgaaggcuggagcaaccccaaaucaaaguugcagauuaauaggcaggucauaguggaucguggggaccggaguggauacuccggcaucuuuagcguagaggguaaaucuuguauuaaccgcugcuucuauguugaacugaucagagggaggaaggaggaaaccgaggugcuauggacaucaaauaguaucgucguguucuguggcacuagcggaaccuacggcacaggguccuggccugauggagcggaccucaaccugaugccaauuuga

SEQ ID NO: 146868 - RNA, 1410 nt, Artificial Sequence; identical to SEQ ID NO: 144162
  derived and/or modified sequence opt3 from neuraminidase__InfluenzaA__AHL97279

SEQ ID NO: 146869 - RNA, 1410 nt, Artificial Sequence; identical to SEQ ID NO: 146752
  derived and/or modified sequence opt3 from neuraminidase__InfluenzaA__AHL97291

SEQ ID NO: 146870 - RNA, 1410 nt, Artificial Sequence; identical to SEQ ID NO: 146740
  derived and/or modified sequence opt3 from neuraminidase__InfluenzaA__AHL97303

SEQ ID NO: 146871 - RNA, 1410 nt, Artificial Sequence
  derived and/or modified sequence opt3 from neuraminidase__InfluenzaA__AHL97339
augaaccccaaucagaagaucauuaccauaggcagcgugucccugacaaucucuacuauuugcuucuuuaugcaaaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacaagcuauagaacucuccugaugaacgaacuuggcguucccuuucaccuggguaccaaacaggugugcauugcuuggaguuccucuagcugucaugacgggaaggccugguugcacgucugcaucacaggagaugacaagaaugcaaccgccuccuucaucuacaacggcaggcucguggauucaguaguuaguuggagcaaagagauucugcggacgcaggaaucugagugugugugcauaaauggcacuuguacagucgugaugaccgacggguccgcuucaggacgcgcagauacuaagauccuguuuauugaggaagguaaaaucgugcauacaagcacccucaguggcucugcccaacacgucgaggaaugcuccugcuauccuagauacccagggguuaggugugugugccgggacaacuggaagggaagcaaccgcccgauaguagauauuaauaucaaggaccacucgaucgugucuuccuacgucuguucaggcuuagugggugacacgccccggaaaaacgauaguagcuccucuagccauugccuggacccuaauaacgaggaagggggacacggcguuaagggcugggcuuucgaugacgggaaugauguguggaugggaagaaccauuaacgagacaucaaggcuugguuaugagacuuuuaaagucaucgaaggcuggaguaauccaaaguccaaauugcagauuaaccgacaggugauaguagaccguggggaucgcagcggauacucuggcaucuucucaguugaggguaagaguuguauuaauagaugcuuuuauguggaacugaucagggggcggaaagaggaaaccgagguccuauggacaagcaacuccaucguggucuucuguggcacuucuggaaccuacggcacagggucguggcccgacggagccgaucucaaucugaugccuauuuga

SEQ ID NO: 146872 - RNA, 1410 nt, Artificial Sequence; identical to SEQ ID NO: 145887
  derived and/or modified sequence opt3 from neuraminidase__InfluenzaA__AHL97351

SEQ ID NO: 146873 - RNA, 1410 nt, Artificial Sequence; identical to SEQ ID NO: 146752
  derived and/or modified sequence opt3 from neuraminidase__InfluenzaA__AHL97363

SEQ ID NO: 146874 - RNA, 1410 nt, Artificial Sequence; identical to SEQ ID NO: 144162
  derived and/or modified sequence opt3 from neuraminidase__InfluenzaA__AHL97387

SEQ ID NO: 146875 - RNA, 1410 nt, Artificial Sequence
  derived and/or modified sequence opt3 from neuraminidase__InfluenzaA__AHL97399
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucauguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuauguaucgugcgacccagauaaguguuaccaauucgcgcuggggcagggaacgacucuaaauaacaugcauucaaauaacaccgugcgagaccguacacccuauagaacucuccugaugaaugaacuuggcgucccuuuucaccuggguaccaaacaggugugcauugcuuggagcaguuccucuugucaugaugggaaggccugguugcacguuugcaucacaggagacgauaagaacgcaaccgccagcuucaucuacaauggcaggcucguggacuccgucgugucauggaguaaagagauucugcggacgcaggaaagcgaguguguaugcauaaacggcacuuguacaguugugaugaccgaugggucugcuuccggaaaggcagacacuaaaauccuguuuauugaggaagguaagaucguccauacaucaacccucagcggcagugcccaacacguggaggaaugcucuugcuauccacgcuacccgggggugagaugugucugcagggauaacuggaagggauccaaucggcccauaguugacauuaacaucaaagaucacagcaucgugucgucuuacguauguuccggcuuagugggugacacgccucgcaagaaugacucaaguagcuccucucauugccuggauccaaacaaugaggaagggggacacggcgucaaaggcugggcuuucgacgaugggaacgacguguggaugggacgaaccauuaaugagacaagcagacuugguuaugagacuuuuaagguuaucgaaggcuggucaaaccccaaaaguaaguugcagauuaauaggcaagugauagucgaucguggggaccgguccggauacagcggcaucuucucuguggagggucgcucauguauuaacagaugcuuuuauguagaacugaucagggggcggaaagaggaaaccgagguucuauggacaaguaauagcaucguggucuucuguggcacuuccggaaccuacggcacagggucuuggccugauggagccgaccucaaccugaugccaauuuga

SEQ ID NO: 146876 - RNA, 1410 nt, Artificial Sequence; identical to SEQ ID NO: 145391
  derived and/or modified sequence opt3 from neuraminidase__InfluenzaA__AHL97411

SEQ ID NO: 146877 - RNA, 1410 nt, Artificial Sequence
  derived and/or modified sequence opt3 from neuraminidase__InfluenzaA__AHL97423
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacauguggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagccgaccucaaccugaugccaauuuga

SEQ ID NO: 146878 - RNA, 1410 nt, Artificial Sequence
  derived and/or modified sequence opt3 from neuraminidase__InfluenzaA__AHL97447
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucauucaguagcucccauugccuggauccaaacaaugaggaagggggacacggcguuaaaggcugggcuuuugacgaugggaacgacguguggaugggacgaaccauuaaugagacaucuagacuugguuaugagacuuucaaggucaucgaaggcuggagcaaccccaaaucaaaguugcagauuaauaggcaagugauaguagaucguggggaccggaguggauacuccggcaucuuuagcguugaggguaaaucuuguauuaaccgcugcuucuauguggaacugaucagagggaggaaggaggaaaccgagguccuauggacaucaaauaguaucguggucuucuguggcacuagcggaaccuacggcacaggguccuggccugauggagccgaccucaaccugaugccaauuuga

SEQ ID NO: 146879 - RNA, 1410 nt, Artificial Sequence; identical to SEQ ID NO: 144162
  derived and/or modified sequence opt3 from neuraminidase__InfluenzaA__AHL97459

SEQ ID NO: 146880 - RNA, 1410 nt, Artificial Sequence; identical to SEQ ID NO: 146752
  derived and/or modified sequence opt3 from neuraminidase__InfluenzaA__AHL97471

SEQ ID NO: 146881 - RNA, 1410 nt, Artificial Sequence; identical to SEQ ID NO: 145887
  derived and/or modified sequence opt3 from neuraminidase__InfluenzaA__AHL97483

SEQ ID NO: 146882 - RNA, 1410 nt, Artificial Sequence; identical to SEQ ID NO: 144162
  derived and/or modified sequence opt3 from neuraminidase__InfluenzaA__AHL97496

SEQ ID NO: 146883 - RNA, 1410 nt, Artificial Sequence; identical to SEQ ID NO: 144162
  derived and/or modified sequence opt3 from neuraminidase__InfluenzaA__AHL97508

SEQ ID NO: 146884 - RNA, 1410 nt, Artificial Sequence
  derived and/or modified sequence opt3 from neuraminidase__InfluenzaA__AHL97520
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgggccagacaaguguuaccaauucgcgcugggacagggcacuacccuaaauaacaugcauucaaauaacacaguccgagaucguacucccuauagaacccuccugaugaaugaacuuggugugccuuuucaccuggggacaaagcagguuugcaucgcuuggagcaguuccucuugucaugacggaaaagccugguugcacgugugcauuaccggcgaugacaagaacgcaacggccagcuucaucuacaauggcaggcucgucgauuccgugguaucauggaguaaagagauccugcggacucaggaaagcgaguguguuugcauuaacgggacauguaccguggucaugacugacggaucugcuuccgguaaggcagauacaaaaauacuguuuaucgaggaaggcaagauugugcauaccucaacgcucagcgggagugcccaacacguggaggaaugcucuugcuauccacgcuacccgggagucagauguguuugcagggacaacuggaagggcuccaaucggcccaucguggauauaaacauuaaagaccacagcaucguaucgucuuacguguguuccgguuuagucggggauaccccucgcaagaaugacucaaguagcuccucucauugccuggacccaaacaaugaggaaggaggccacggcgugaaagggugggcuuucgaugacggaaacgauguuuggaugggucgaacaaucaaugagacuagcagacuuggcuaugagaccuuuaaggugauugaaggguggucaaaccccaaaaguaaguugcagaucaauaggcaggucauuguggaccggggagaucguuccggcuacagcgguauauucucuguagaggggaaaucauguaucaaccgcugcuuuuauguugaacugauuagaggcaggaaggaggaaacagaggugcuauggaccaguaauagcaucgucguguucuguggaacuuccggcacauacgggaccggaucuuggccugacggugccgaucucaaccugaugccaaucuga

SEQ ID NO: 146885 - RNA, 1410 nt, Artificial Sequence; identical to SEQ ID NO: 144162
  derived and/or modified sequence opt3 from neuraminidase__InfluenzaA__AHL97532

SEQ ID NO: 146886 - RNA, 1410 nt, Artificial Sequence; identical to SEQ ID NO: 144162
  derived and/or modified sequence opt3 from neuraminidase__InfluenzaA__AHL97544

SEQ ID NO: 146887 - RNA, 1410 nt, Artificial Sequence; identical to SEQ ID NO: 145887
  derived and/or modified sequence opt3 from neuraminidase__InfluenzaA__AHL97556

SEQ ID NO: 146888 - RNA, 1410 nt, Artificial Sequence
  derived and/or modified sequence opt3 from neuraminidase__InfluenzaA__AHL97568
augaaccccaaucagaagaucauuaccauaggcagcgugucccugacaaucucugccauuugcuucuuuaugcaaaucgcuauucucaucacuacggucacccuuagauucaaacaguacgaguuuaacucaccuccaaauaaccagguuaugcugugugaaccgacaauaaucgagaggaauauuacugaaaucguguauuugaccaacacaaccauugagaaggaaaucugccccaaaccugcagaguaccggaauuggaguaagccacagugugacauaacuggguucgcccccuuuagcaaagauaacuccauucgcuuaucugcgggaggugacaucuggguaacacgagagccuuaugugucgugcgauccagacaaguguuaccaauucgcucugggccaggggaccacgcuaacuaauguccacucaaacaauaccgugcgugauagaacacccuauaggacucuccugaugaacgaacuuggaguuccuuuucaucugggcaccaaacaggugugcauugccuggagcaguuccucuugucacgacgguaaggcaugguugcaugucugcaucacaggggaugacaagaaugccaccgcuagcuucaucuacaacggacggcucguggauuccguaguuucauggaguaaagagauucugcgcacgcaggaaagcgagugugugugcauaaauggcacuuguacagucgugaugaccgacggcucugcauccgggaaggccgauacuaaaauccuguuuauugaggaaggaaagaucgugcacacaucaacccucagcgguagugcucaacaugucgaggaaugcucuugcuauccaagauacccgggcguuaggugugugugccgggacaacuggaagggguccaaccgccccauaguagauauuaauaucaaagaccacagcaucgugucgcgauacgucuguucuggauuagugggcgacacgccuagaaagaacgauuccucaaguagcucccacugccuggacccaaauaacgaggaaggugggcauggaguuaaaggcugggccuucgaugacggcaaugauguguggauggggaggaccauuaacgagacaucucggcuuggauaugagacuuuuaaggucaucgaagguuggagcaaucccaaaucaaaguugcagauuaaccgucaggugauaguagaccgcggcgauagaaguggguacuccggaaucuucagcguugagggcaaaucuuguauuaauaggugcuuuuauguggaacugauccggggucgaaaggaggaaaccgagguccuauggacaucaaacaguaucguggucuucugugggacuagcggcaccuacggaacaggcuccuggccugacggggcggaucucaaucugaugccaauuuga

SEQ ID NO: 146889 - RNA, 1410 nt, Artificial Sequence; identical to SEQ ID NO: 146802
  derived and/or modified sequence opt3 from neuraminidase__InfluenzaA__AHL97580

SEQ ID NO: 146890 - RNA, 1410 nt, Artificial Sequence
  derived and/or modified sequence opt3 from neuraminidase__InfluenzaA__AHL97592
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccguacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggggccaaacaaugaggaaggaggccacggcgugaaagggugggcuuucgaugacggaaacgaugucuggaugggucgaaccaucaaugagacaagcagaucaggcuaugagacuuuuaaggugauugaaggguggaguaaccccaaauccaaacuucagaucaauaggcagguaauuguugaccggggagaucguagcggcuacucugguauauucucaguggaggggaagaguuguaucaaccgcugcuuuuaugucgaauugauuagaggcaggaaggaggaaaccgaggugcuguggacaagcaauuccaucgucguguucuguggaacuucuggcaccuacgggacaggaucguggccugacggugccgaucuaaaccucaugccaaucuga

SEQ ID NO: 146891 - RNA, 1410 nt, Artificial Sequence; identical to SEQ ID NO: 144162
  derived and/or modified sequence opt3 from neuraminidase__InfluenzaA__AHL97604

SEQ ID NO: 146892 - RNA, 1410 nt, Artificial Sequence
  derived and/or modified sequence opt3 from neuraminidase__InfluenzaA__AHL97616
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagguucugcggacgcaggaaagcgagugugugugcauuaacggcacuuguacagucgugaugaccgaugggucugcuuccggaaaggcagacacuaaaauacuguuuaucgaggaagguaagauugugcauacaucaacccucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccaucaaugagacaagcagacuugguuaugagacuuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaaccgagguccuauggacaaguaauagcaucguggucuucuguggcacuuccggaaccuacggcacagggucuuggccugauggagccgaccucaaccugaugccaaucuga

SEQ ID NO: 146893 - RNA, 1410 nt, Artificial Sequence; identical to SEQ ID NO: 146752
  derived and/or modified sequence opt3 from neuraminidase__InfluenzaA__AHL97628

SEQ ID NO: 146894 - RNA, 1410 nt, Artificial Sequence; identical to SEQ ID NO: 144162
  derived and/or modified sequence opt3 from neuraminidase__InfluenzaA__AHL97640

SEQ ID NO: 146895 - RNA, 1410 nt, Artificial Sequence; identical to SEQ ID NO: 145910
  derived and/or modified sequence opt3 from neuraminidase__InfluenzaA__AHL97652

SEQ ID NO: 146896 - RNA, 1410 nt, Artificial Sequence; identical to SEQ ID NO: 145910
  derived and/or modified sequence opt3 from neuraminidase__InfluenzaA__AHL97664

SEQ ID NO: 146897 - RNA, 1410 nt, Artificial Sequence; identical to SEQ ID NO: 145391
  derived and/or modified sequence opt3 from neuraminidase__InfluenzaA__AHL97676

SEQ ID NO: 146898 - RNA, 1410 nt, Artificial Sequence; identical to SEQ ID NO: 144162
  derived and/or modified sequence opt3 from neuraminidase__InfluenzaA__AHL97688

SEQ ID NO: 146899 - RNA, 1410 nt, Artificial Sequence; identical to SEQ ID NO: 145887
  derived and/or modified sequence opt3 from neuraminidase__InfluenzaA__AHL97700

SEQ ID NO: 146900 - RNA, 1410 nt, Artificial Sequence
  derived and/or modified sequence opt3 from neuraminidase__InfluenzaA__AHL97712
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaccaguagcucccauugccuggauccaaacaaugaggaagggggacacggcguuaaaggcugggcuuucgacgaugggaacgacguguggaugggacgaacaauuaaugagacuucuagacuugguuaugagaccuuuaaggucaucgaaggcuggagcaaccccaaaucaaaguugcagauuaauaggcaagugauaguagaucguggggaccggaguggauacuccggcaucuucagcguugaggguaaaucuuguauuaaccgcugcuuuuauguggaacugaucagagggaggaaggaggaaacagagguccuauggacuucaaauaguaucguggucuucuguggcaccagcggaacauacggcaccggguccuggccugauggagccgaccucaaccugaugccaauuuga

SEQ ID NO: 146901 - RNA, 1410 nt, Artificial Sequence; identical to SEQ ID NO: 145887
  derived and/or modified sequence opt3 from neuraminidase__InfluenzaA__AHL97724

SEQ ID NO: 146902 - RNA, 1410 nt, Artificial Sequence; identical to SEQ ID NO: 144162
  derived and/or modified sequence opt3 from neuraminidase__InfluenzaA__AHL97736

SEQ ID NO: 146903 - RNA, 1410 nt, Artificial Sequence
  derived and/or modified sequence opt3 from neuraminidase__InfluenzaA__AHL97760
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgaugagaacgcaaccgccagcuucaucuacaauggcaggcucguggacuccguaguuucauggaguaaggaaauucugcggacgcaggagagcgagugugugugcauaaacggcacuuguacagucgugaugaccgaugggucugcuuccggaaaagcagacacuaagauccuguuuauugaagaggguaaaaucgugcauacaucaacccucagcggcagugcccaacacgucgaagagugcucuugcuauccacgcuacccggggguuagaugugugugcagggauaacuggaagggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaagaagagaccgagguccuauggacaaguaauagcaucguggucuucuguggcacuuccggaaccuacggcacagggucuuggccugauggagccgaccucaaccugaugccaauuuga

SEQ ID NO: 146904 - RNA, 1410 nt, Artificial Sequence
  derived and/or modified sequence opt3 from neuraminidase__InfluenzaA__AHL97772
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcguggucguguucuguggcacuuccggaaccuacggcacagggucuuggccugauggagccgaccucaaccugaugccaaucuga

SEQ ID NO: 146905 - RNA, 1410 nt, Artificial Sequence; identical to SEQ ID NO: 145391
  derived and/or modified sequence opt3 from neuraminidase__InfluenzaA__AHL97784

SEQ ID NO: 146906 - RNA, 1410 nt, Artificial Sequence; identical to SEQ ID NO: 144162
  derived and/or modified sequence opt3 from neuraminidase__InfluenzaA__AHL97796

SEQ ID NO: 146907 - RNA, 1410 nt, Artificial Sequence; identical to SEQ ID NO: 144162
  derived and/or modified sequence opt3 from neuraminidase__InfluenzaA__AHL97808

SEQ ID NO: 146908 - RNA, 1410 nt, Artificial Sequence; identical to SEQ ID NO: 144162
  derived and/or modified sequence opt3 from neuraminidase__InfluenzaA__AHL97820

SEQ ID NO: 146909 - RNA, 1410 nt, Artificial Sequence
  derived and/or modified sequence opt3 from neuraminidase__InfluenzaA__AHL97832
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaguuggagcaagccacagugugggauaacaggauucgcacccuuuuccaaagauaacucuauucgguuaucggccgguggcgacaucuggguaacccgcgagccuuaugugucaugcgauccagacaaguguuaccaauucgcgcuggggcagggaacgacucuaaauaacguccauagcaauaacaccgugcgagaucguacacccuauagaacucuccugaugaaugaacuuggcguuccuuuucaccuggguaccaaacaggugugcauugcuuggaguuccucuagcugucaugacgggaaggccugguugcacgucugcaucacaggagaugacaagaacgcaaccgccuccuucaucuacaauggcaggcucguggauucaguaguuaguuggagcaaagagauucugcggacgcaggaaucugagugugugugcauaaacggcacuuguacagucgugaugaccgacggguccgcuucaggaaaggcagauacuaaaauccuguuuauugaggaagguaagaucgugcauacaagcacccucaguggcucugcccaacacgucgaggaaugcuccugcuauccacgcuacccggggguuagaugugugugcagggacaauuggaagggaagcaaccggcccauaguagauauuaacaucaaagaccacucgaucgugucuuccuacgucuguucaggcuuagugggugacacgccucgcaagaaugauaguagcuccucuagccauugccuggacccaaacaaugaggaagggggacacggcguuaaaggcugggcuuucgaugacgggaacgauguguggaugggacgaaccauuaaugagacaucaagacuugguuaugagacuuuuaaggucaucgaaggcuggaguaaccccaaauccaaguugcagauuaauaggcaagugauaguagaccguggggaucggagcggauacucuggcaucuucucaguugaggguaaaaguuguauuaaccgcugcuuuuauguggaacugaucagagggaggaaggaggaaaccgagguccuauggacaagcaauuccaucguggucuucuguggcacuucuggaaccuacggcacagggucguggccugacggagccgaucucaaccugaugccaauuuga

SEQ ID NO: 146910 - RNA, 1410 nt, Artificial Sequence; identical to SEQ ID NO: 144162
  derived and/or modified sequence opt3 from neuraminidase__InfluenzaA__AHL97844

SEQ ID NO: 146911 - RNA, 1410 nt, Artificial Sequence; identical to SEQ ID NO: 146903
  derived and/or modified sequence opt3 from neuraminidase__InfluenzaA__AHL97856

SEQ ID NO: 146912 - RNA, 1410 nt, Artificial Sequence; identical to SEQ ID NO: 144162
  derived and/or modified sequence opt3 from neuraminidase__InfluenzaA__AHL97868

SEQ ID NO: 146913 - RNA, 1410 nt, Artificial Sequence; identical to SEQ ID NO: 145887
  derived and/or modified sequence opt3 from neuraminidase__InfluenzaA__AHL97880

SEQ ID NO: 146914 - RNA, 1410 nt, Artificial Sequence; identical to SEQ ID NO: 144162
  derived and/or modified sequence opt3 from neuraminidase__InfluenzaA__AHL97892

SEQ ID NO: 146915 - RNA, 1410 nt, Artificial Sequence; identical to SEQ ID NO: 144162
  derived and/or modified sequence opt3 from neuraminidase__InfluenzaA__AHL97904

SEQ ID NO: 146916 - RNA, 1410 nt, Artificial Sequence; identical to SEQ ID NO: 145899
  derived and/or modified sequence opt3 from neuraminidase__InfluenzaA__AHL97916

SEQ ID NO: 146917 - RNA, 1410 nt, Artificial Sequence; identical to SEQ ID NO: 144162
  derived and/or modified sequence opt3 from neuraminidase__InfluenzaA__AHL97928

SEQ ID NO: 146918 - RNA, 1410 nt, Artificial Sequence; identical to SEQ ID NO: 146878
  derived and/or modified sequence opt3 from neuraminidase__InfluenzaA__AHL97952

SEQ ID NO: 146919 - RNA, 1410 nt, Artificial Sequence; identical to SEQ ID NO: 144162
  derived and/or modified sequence opt3 from neuraminidase__InfluenzaA__AHL97964

SEQ ID NO: 146920 - RNA, 1410 nt, Artificial Sequence; identical to SEQ ID NO: 144162
  derived and/or modified sequence opt3 from neuraminidase__InfluenzaA__AHL97976

SEQ ID NO: 146921 - RNA, 1410 nt, Artificial Sequence; identical to SEQ ID NO: 144162
  derived and/or modified sequence opt3 from neuraminidase__InfluenzaA__AHL97988

SEQ ID NO: 146922 - RNA, 1410 nt, Artificial Sequence
  derived and/or modified sequence opt3 from neuraminidase__InfluenzaA__AHL98000
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaugaaagcgagugugugugcauaaacggcacuuguacagucgugaugaccgaugggucugcuuccggaaaggcagacacuaaaauccuguuuauugaggaagguaagaucgugcacacaucaacccucagcggcagugcccagcacgucgaggaaugcucuugcuauccacgcuacccggggguuagaugugugugcagggauaacuggaagggauccaaucggcccauaguagacauuaacaucaaagaucauagcaucgugucgucuuacgucuguuccggcuuagugggugacacgccucgcaagaaagacucaaguagcuccucucacugccuggauccaaauaacgaggaagggggacauggcguuaagggcugggcuuucgacgaugggaaugacguguggaugggacgaaccauuaacgagacaagcagacuugguuaugagacuuuuaaagucaucgaaggcuggucaaaucccaagaguaaauugcaaauuaacaggcaagugauaguagaucguggggaccgguccggauacagcggcaucuucucuguugaggguaagucauguauuaaucgcugcuuuuauguggaacugaucagagggaggaaggaggaaaccgagguccuauggacaaguaacagcaucguggucuucuguggcacuuccggaaccuacggcacagggucuuggccugauggagccgaccucaaucugaugccaauuuga

SEQ ID NO: 146923 - RNA, 1410 nt, Artificial Sequence
  derived and/or modified sequence opt3 from neuraminidase__InfluenzaA__AHL98012
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagaggugcugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaaggggaccacggagugaaaggcugggcuuucgaugacggcaacgaugucuggauggggcgaaccaucaaugagacaagcagacuuggauaugagacuuuuaaggugauugaagguuggucaaaccccaaaaguaaguugcagaucaauaggcagguaauuguugaccggggcgaucguuccggguacagcggaauauucucuguggagggcaaaucauguaucaaccgcugcuuuuaugucgaacugauuagagguaggaaggaggaaaccgaggugcuauggacaaguaauagcaucgucguguucugugggacuuccggcaccuacggaacaggcucuuggccugacggggccgaucucaaccugaugccaaucuga

SEQ ID NO: 146924 - RNA, 1410 nt, Artificial Sequence; identical to SEQ ID NO: 145899
  derived and/or modified sequence opt3 from neuraminidase__InfluenzaA__AHL98048

SEQ ID NO: 146925 - RNA, 1410 nt, Artificial Sequence; identical to SEQ ID NO: 145899
  derived and/or modified sequence opt3 from neuraminidase__InfluenzaA__AHL98060

SEQ ID NO: 146926 - RNA, 1410 nt, Artificial Sequence; identical to SEQ ID NO: 145899
  derived and/or modified sequence opt3 from neuraminidase__InfluenzaA__AHL98072

SEQ ID NO: 146927 - RNA, 1410 nt, Artificial Sequence; identical to SEQ ID NO: 144162
  derived and/or modified sequence opt3 from neuraminidase__InfluenzaA__AHL98084

SEQ ID NO: 146928 - RNA, 1410 nt, Artificial Sequence; identical to SEQ ID NO: 145899
  derived and/or modified sequence opt3 from neuraminidase__InfluenzaA__AHL98096

SEQ ID NO: 146929 - RNA, 1410 nt, Artificial Sequence; identical to SEQ ID NO: 144162
  derived and/or modified sequence opt3 from neuraminidase__InfluenzaA__AHL98119

SEQ ID NO: 146930 - RNA, 1410 nt, Artificial Sequence; identical to SEQ ID NO: 144162
  derived and/or modified sequence opt3 from neuraminidase__InfluenzaA__AHL98131

SEQ ID NO: 146931 - RNA, 1410 nt, Artificial Sequence; identical to SEQ ID NO: 144162
  derived and/or modified sequence opt3 from neuraminidase__InfluenzaA__AHL98143

SEQ ID NO: 146932 - RNA, 1410 nt, Artificial Sequence
  derived and/or modified sequence opt3 from neuraminidase__InfluenzaA__AHL98155
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaacaguaaauccaaguugcagauuaauaggcaagugauaguagaucguggggaccggagcggauacucuggcaucuucucaguugaggguaaaaguuguauuaaccgcugcuuuuauguggaacugaucagagggaggaaggaggaaaccgagguccuauggacaagcaauuccaucguggucuucuguggcacuucuggaaccuacggcacagggucguggcccgauggagccgaccucaaccugaugccuauuuga

SEQ ID NO: 146933 - RNA, 1410 nt, Artificial Sequence; identical to SEQ ID NO: 144162
  derived and/or modified sequence opt3 from neuraminidase__InfluenzaA__AHL98167

SEQ ID NO: 146934 - RNA, 1410 nt, Artificial Sequence; identical to SEQ ID NO: 144162
  derived and/or modified sequence opt3 from neuraminidase__InfluenzaA__AHL98179

SEQ ID NO: 146935 - RNA, 1410 nt, Artificial Sequence; identical to SEQ ID NO: 144162
  derived and/or modified sequence opt3 from neuraminidase__InfluenzaA__AHL98191

SEQ ID NO: 146936 - RNA, 1410 nt, Artificial Sequence; identical to SEQ ID NO: 145899
  derived and/or modified sequence opt3 from neuraminidase__InfluenzaA__AHL98215

SEQ ID NO: 146937 - RNA, 1410 nt, Artificial Sequence
  derived and/or modified sequence opt3 from neuraminidase__InfluenzaA__AHL98227
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgacaucguguauuugacaaacaccacuauugaaaaggagaucugccccaaaccugcugaauacaggaauuggaguaagccacagugugggauaacaggauucgcacccuuuagcaaagauaacuccauucgguuaucugccgguggcgacaucuggguaacccgcgagccuuaugugucgugcgauccagacaaguguuaccaauucgcgcuggggcagggaacgacucuaaauaacaugcauucaaauaacaccguccgagaucguacacccuauagaacucuccugaugaaugagcuuggcgugccuuuucaccuggguaccaagcagguuugcauugcuuggagcaguuccucuugucaugacgggaaagccugguugcacgugugcaucacaggagaugacaagaacgcaaccgccagcuucaucuacaauggcaggcucgucgauuccgugguaucauggaguaaagaaauucugcggacgcaggagagcgaauguguuugcauaaacggcacuuguacaguggucaugaccgacgggucugcuuccggaaaggcagauacuaaaauccuguuuauugaggaggguaagaucgugcauacaucaacccucagcggcagugcccaacacguggaagagugcucuugcuauccacgcuacccgggggucagauguguuugcagggacaacuggaagggauccaaucggcccauaguggauauuaacaucaaagaccacagcaucguaucgucuuacguguguuccggcuuagucggugacacgccucgcaagaaugauucaaguagcuccucucauugccuggacccaaacaaugaagaagggggacacggcgugaaaggcugggcuuucgaugacgggaacgauguuuggaugggacgaaccauuaaugagacaagcagacuugguuaugagacuuuuaaggugaucgagggcuggucaaaccccaaaaguaaguugcagauuaauaggcaggucauaguggaccguggggaucgguccggauacagcggcaucuucucuguagaagguaaaucauguauuaaccgcugcuuuuauguugagcugaucagagggaggaaggaagagaccgaagugcuauggacaaguaauagcaucgucguguucuguggcacuuccggaaccuacggcacagggucuuggccugacggagccgaucucaaccugaugccaauuuga

SEQ ID NO: 146938 - RNA, 1410 nt, Artificial Sequence; identical to SEQ ID NO: 144162
  derived and/or modified sequence opt3 from neuraminidase__InfluenzaA__AHL98239

SEQ ID NO: 146939 - RNA, 1410 nt, Artificial Sequence; identical to SEQ ID NO: 144162
  derived and/or modified sequence opt3 from neuraminidase__InfluenzaA__AHL98251

SEQ ID NO: 146940 - RNA, 1410 nt, Artificial Sequence; identical to SEQ ID NO: 145910
  derived and/or modified sequence opt3 from neuraminidase__InfluenzaA__AHL98263

SEQ ID NO: 146941 - RNA, 1410 nt, Artificial Sequence; identical to SEQ ID NO: 144162
  derived and/or modified sequence opt3 from neuraminidase__InfluenzaA__AHL98275

SEQ ID NO: 146942 - RNA, 1410 nt, Artificial Sequence; identical to SEQ ID NO: 146808
  derived and/or modified sequence opt3 from neuraminidase__InfluenzaA__AHL98287

SEQ ID NO: 146943 - RNA, 1410 nt, Artificial Sequence
  derived and/or modified sequence opt3 from neuraminidase__InfluenzaA__AHL98298
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgggagaaauauuaccgagaucguguauuugacaaacaccacuauugaaaaggagaucugccccaaaccugcugaauacaggaauuggaguaagccacaguguggaauaacagguuucgcacccuuuagcaaagacaacuccauucgguuaucugccggcggggauaucuggguaacccgcgagccuuaugugucgugcgacccagauaaguguuaccaauucgcgcugggacagggcacgacucuaaauaacguccauucaaauaacaccgugcgagaccguacacccuauagaacucuccugaugaaugagcuugguguuccuuuucaccuggggaccaaacaggugugcauugcuuggagcaguuccucuugucaugauggaaaggccugguugcacgucugcaucacaggcgacgauaagaacgcaaccgccagcuucaucuacaauggcaggcucguggacuccguaguuucauggaguaaagaaauucugcggacgcaggagagcgaaugugugugcauaaacgggacuuguacagucgugaugaccgauggaucugcuuccgguaaggcagacacuaaaauccuguuuauugaggagggcaagaucgugcauacaucaacccucagcgggagugcccaacacgucgaagagugcucuugcuauccacgcuacccgggaguuagaugugugugcagggauaacuggaagggcuccaaucggcccauaguagacauuaacaucaaagaucacagcaucgugucgucuuacgucuguuccgguuuagugggggacacgccucgcaagaaugacucaaguagcuccucucauugccuggauccaaacaaugaagagggaggccacggcguuaaagggugggcuuucgacgauggaaacgacguguggaugggucgaaccauuaaugaaacaagcagacuuggcuaugagacuuuuaaggucaucgagggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 146944 - RNA, 1410 nt, Artificial Sequence; identical to SEQ ID NO: 144162
  derived and/or modified sequence opt3 from neuraminidase__InfluenzaA__AHL98310

SEQ ID NO: 146945 - RNA, 1410 nt, Artificial Sequence; identical to SEQ ID NO: 144162
  derived and/or modified sequence opt3 from neuraminidase__InfluenzaA__AHL98322

SEQ ID NO: 146946 - RNA, 1410 nt, Artificial Sequence
  derived and/or modified sequence opt3 from neuraminidase__InfluenzaA__AHL98334
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaagugguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 146947 - RNA, 1410 nt, Artificial Sequence
  derived and/or modified sequence opt3 from neuraminidase__InfluenzaA__AHL98346
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaacgagguccuauggaccaguaauagcaucguggucuucuguggcacauccggaacuuacggcaccgggucuuggccugacggagccgaucucaaccugaugccaauuuga

SEQ ID NO: 146948 - RNA, 1410 nt, Artificial Sequence; identical to SEQ ID NO: 144162
  derived and/or modified sequence opt3 from neuraminidase__InfluenzaA__AHL98357

SEQ ID NO: 146949 - RNA, 1410 nt, Artificial Sequence; identical to SEQ ID NO: 145910
  derived and/or modified sequence opt3 from neuraminidase__InfluenzaA__AHL98369

SEQ ID NO: 146950 - RNA, 1410 nt, Artificial Sequence
  derived and/or modified sequence opt3 from neuraminidase__InfluenzaA__AHL98381
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgggccagacaaguguuaccaauucgcgcugggacagggcacgacucuaaauaacaugcauucaaauaacaccguccgagaucguacacccuauagaacucuccugaugagcgaacuuggugugccuuuucaccuggggaccaagcagguuugcauugcuuggaguuccucuagcugucaugacggaaaagccugguugcacgugugcaucacaggcgaugacaagaaugcaaccgccuccuucaucuacaacggcaggcucgucgauucagugguaaguuggagcaaagagauucugcggacgcaggaaucugaguguguuugcauaaaugggacuuguacaguggucaugaccgacggauccgcuucagguaaggcagauacuaaaauccuguuuauugaggaaggcaagaucgugcauacaagcacccucagugggucugcccaacacguggaggaaugcuccugcuauccacgcuacccgggagucagauguguuugcagggacaacuggaagggcagcaaccggcccauaguggauauuaauaucaaagaccacucgacgguaucuuccuacguguguucagguuuagucggggauaccccucgcaagaacgacaguagcuccucuagccauugccuggacccaaauaacgaggaaggaggccacggcgugaaagggugggcuuucgaugacggaaaugauguuuggaugggucgaacaaucaacgagacuucaagacuuggcuaugagaccuuuaaggugauugaaggguggaguaaucccaaauccaaguugcagaucaacaggcaggucauuguggaccggggagaucguagcggcuacucugguauauucucaguagaggggaaaaguuguaucaaucgcugcuuuuauguugaacugauuagaggcaggaaggaggaaacagaggugcuauggacuagcaacuccaucgucguguucuguggaaccucuggcacauacgggaccggaucguggccugacggugccgaucucaaucugaugccaaucuga

SEQ ID NO: 146951 - RNA, 1410 nt, Artificial Sequence
  derived and/or modified sequence opt3 from neuraminidase__InfluenzaA__AHL98393
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuauguaucgugcgggccagacaaguguuaccaauucgcgcugggacagggcacgacucuaaauaacaugcauucaaauaacaccgugcgagaucguacacccuauagaacucuccugaugaaugaacuuggugucccuuuucaccuggggaccaaacaggugugcauugcuuggagcaguuccucuugucaugacggaaaggccugguugcacguuugcaucacaggcgaugacaagaacgcaaccgccagcuucaucuacaauggcaggcucguggauuccgucgugucauggaguaaagagauucugcggacgcaggaaagcgaguguguaugcauaaacgggacuuguacaguugugaugaccgacggaucugcuuccgguaaggcagauacuaaaauccuguuuauugaggaaggcaagaucguccauacaucaacccucagcgggagugaccaacacauagaggaaugcucuugcuauccacgcuacccgggagugagaugugugugcagggauaacuggaagggcuccaaucggcccauugucgacaucaacaucaaagaucacagcauuguuucgucuuacguguguuccgguuuaguaggggacacgccucgcaagaaugacucaaguagcuccucucauugccuggauccaaacaaugaggaaggaggccacggcgugaaagggugggccuucgacgauggaaacgacgucuggaugggucgaaccaucaaugagacaagcagacuuggcuaugagacuuuuaaggugauugaaggguggucaaaccccaaaaguaaguugcagauaaauaggcagguuaucguggaucggggagaccguuccggcuacagcgguauuuucucugucgaggggaaaucauguaucaaccgcugcuuuuauguggaacugaucagaggcaggaaggaggaaaccgagguacuauggacaaguaauagcauuguuguguucuguggaacuuccggcaccuacgggacaggaucuuggccugauggugcugaccucaaccugaugccaauauga

SEQ ID NO: 146952 - RNA, 1410 nt, Artificial Sequence; identical to SEQ ID NO: 144162
  derived and/or modified sequence opt3 from neuraminidase__InfluenzaA__AHL98405

SEQ ID NO: 146953 - RNA, 1410 nt, Artificial Sequence; identical to SEQ ID NO: 144162
  derived and/or modified sequence opt3 from neuraminidase__InfluenzaA__AHL98417

SEQ ID NO: 146954 - RNA, 1410 nt, Artificial Sequence; identical to SEQ ID NO: 144162
  derived and/or modified sequence opt3 from neuraminidase__InfluenzaA__AHL98429

SEQ ID NO: 146955 - RNA, 1410 nt, Artificial Sequence
  derived and/or modified sequence opt3 from neuraminidase__InfluenzaA__AHL98452
augaaccccacccagaagaucauuacaauaggcagcgugugcaugacuaucgggauggccaaucugauucuccaaaucggaaacauuaucuccauauggaucucucacucaauucagcuugguaaucagagucagaucgagacguguaaccaaagcgucauuaccuacgaaaauaacacauggguuaaucagacuuaugugaacaucuccaauaccaacuucgcugcaggccagucuguagugucggucaaacuggccgggaauaguagcuugugcccugugaguggaugggcgauauacuccaaggacaacucuguuagaauuggcagcaaaggugauguguuugucaucagggagccauucauuuccuguucaccguuagaaugccggacauuuuuccugacccagggggcucuacucaaugacaagcauaguaacggaacuaucaaagaucgcagccccuaucgaacacugaugucuuguccuaucggcgaggugccaucccccuacaauucacguuuugaaagcguagccuggagugcaucugccugccacgacggcauuaacuggcuuaccauagggaucuccggaccugauagcggugcuguugcagugcugaaguauaacggcauuaucacggacacuauaaagucguggaaaaauaacauuuugagaacccaagagucugagugugccugcgucaauggguccuguuucacaaucaugacugauggaccaucagacggccaggcuaguuacaagaucuuuaggauugaaaaagguaagaucgugaaaagcguggagaugaacgcccccaauuaucauuacgaagagugcuccuguuacccugauucuagcgagauuaccugcgucugccgggacaacuggcacgggucaaaucgcccauggguuaguuucaaccagaaucucgaauaucagauaggauacaucuguuccggcguguuuggcgauaacccgagacccaaugacaagacagggagcugcggaccuguaucuucaaacggugcgaauggcgugaagggguucaguuuuaaauauggaaacggcgucuggauugguaggaccaagagcaucuccucucggaaaggguucgagaugaucugggauccaaauggcuggacgggaacugacaacaacuuuucgauuaagcaagacauagugggcaucaaugaauggagcggguacuccggaucauucguucagcaucccgagcugacaggucuggauuguauucgcccuugcuucuggguggaacucauccgaggcagaccaaaagagaacaccauuuggacuucagggucuagcaucuccuuuuguggagucaauucagacacagugggcuggagcuggcccgauggugcagaguuaccguucaccauagacaaguga

SEQ ID NO: 146956 - RNA, 1410 nt, Artificial Sequence
  derived and/or modified sequence opt3 from neuraminidase__InfluenzaA__AHL98474
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccuaauagcggugcuguugcagugcugaaguauaacggcauuaucaccgauacgauaaagucguggagaaauaacauuuugaggacucaagagucugagugugccugcgucaauggguccuguuucaccaucaugacagacggaccaucagauggccaggcuaguuacaaaaucuuucggauugaaaaggguaaaaucgugaagucaguggagaugaacgcccccaauuaucauuacgaagagugcuccuguuacccugacucuagcgagauuacuugcgucugccgcgauaacuggcacgggucaaauagaccauggguuaguuucaaccagaaucucgaauaucagauaggauacaucuguuccggcguguuuggcgacaacccgaggcccaaugauaaaaccgggagcugcggaccuguaucuucaaacggugcgaauggcgugaagggguucaguuuuaaguauggaaacggcgucuggauuggucggacaaaaagcaucuccucucgcaagggguucgagaugaucugggacccaaacggcuggaccggaacggauaauaacuuuucgauuaaacaagacauagugggcaucaaugaauggagcggguacuccggaucauucguucagcaucccgagcugacuggucuggacuguauucgaccuugcuucuggguggaacucaucagaggcaggccaaaggagaacacaauuuggaccagugggucuagcaucuccuuuuguggagucaauucagauacugugggcuggagcuggcccgacggugcagaguuaccguucacaauagauaaauga

SEQ ID NO: 146957 - RNA, 1410 nt, Artificial Sequence
  derived and/or modified sequence opt3 from neuraminidase__InfluenzaA__AHL98485
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaauacucagcggcagugcccaacacgucgaggaaugcucuugcuauccacgcuacccggggguuagaugugugugcagggauaacuggaagggauccaaucggcccauuguagacaucaacaucaaagaucacagcauugugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacgaucaaugagaccagcagacuugguuaugagacauuuaaggucauugaaggcuggucaaaccccaaaaguaaguugcagauaaauaggcaagugaucguagaucguggggaccgguccggauacagcggcauuuucucuguugaggguaaaucauguaucaaccgcugcuuuuauguggaacugaucagagggaggaaggaggaaacugagguccuauggaccaguaauagcauuguggucuucuguggcacauccggaacuuacggcaccgggucuuggccugauggagccgaccucaaccugaugccaauauga

SEQ ID NO: 146958 - RNA, 1410 nt, Artificial Sequence; identical to SEQ ID NO: 145391
  derived and/or modified sequence opt3 from neuraminidase__InfluenzaA__AHL98497

SEQ ID NO: 146959 - RNA, 1410 nt, Artificial Sequence; identical to SEQ ID NO: 144162
  derived and/or modified sequence opt3 from neuraminidase__InfluenzaA__AHL98509

SEQ ID NO: 146960 - RNA, 1410 nt, Artificial Sequence; identical to SEQ ID NO: 144162
  derived and/or modified sequence opt3 from neuraminidase__InfluenzaA__AHL98521

SEQ ID NO: 146961 - RNA, 1410 nt, Artificial Sequence; identical to SEQ ID NO: 145391
  derived and/or modified sequence opt3 from neuraminidase__InfluenzaA__AHL98533

SEQ ID NO: 146962 - RNA, 1410 nt, Artificial Sequence; identical to SEQ ID NO: 144162
  derived and/or modified sequence opt3 from neuraminidase__InfluenzaA__AHL98545

SEQ ID NO: 146963 - RNA, 1410 nt, Artificial Sequence; identical to SEQ ID NO: 144162
  derived and/or modified sequence opt3 from neuraminidase__InfluenzaA__AHL98557

SEQ ID NO: 146964 - RNA, 1410 nt, Artificial Sequence; identical to SEQ ID NO: 144162
  derived and/or modified sequence opt3 from neuraminidase__InfluenzaA__AHL98569

SEQ ID NO: 146965 - RNA, 1410 nt, Artificial Sequence
  derived and/or modified sequence opt3 from neuraminidase__InfluenzaA__AHL98581
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcaauaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaacggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaauuggaagggauccaaccggcccauaguagauauuaauaucaaagaccacagcaucgugucgucuuacgucuguuccggcuuagugggugauacgccucgcaagaacgacucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 146966 - RNA, 1410 nt, Artificial Sequence; identical to SEQ ID NO: 144162
  derived and/or modified sequence opt3 from neuraminidase__InfluenzaA__AHL98593

SEQ ID NO: 146967 - RNA, 1410 nt, Artificial Sequence; identical to SEQ ID NO: 145899
  derived and/or modified sequence opt3 from neuraminidase__InfluenzaA__AHL98605

SEQ ID NO: 146968 - RNA, 1410 nt, Artificial Sequence; identical to SEQ ID NO: 145391
  derived and/or modified sequence opt3 from neuraminidase__InfluenzaA__AHL98617

SEQ ID NO: 146969 - RNA, 1410 nt, Artificial Sequence; identical to SEQ ID NO: 145391
  derived and/or modified sequence opt3 from neuraminidase__InfluenzaA__AHL98629

SEQ ID NO: 146970 - RNA, 1410 nt, Artificial Sequence; identical to SEQ ID NO: 144162
  derived and/or modified sequence opt3 from neuraminidase__InfluenzaA__AHL98641

SEQ ID NO: 146971 - RNA, 1410 nt, Artificial Sequence; identical to SEQ ID NO: 146740
  derived and/or modified sequence opt3 from neuraminidase__InfluenzaA__AHL98653

SEQ ID NO: 146972 - RNA, 1410 nt, Artificial Sequence; identical to SEQ ID NO: 144162
  derived and/or modified sequence opt3 from neuraminidase__InfluenzaA__AHL98665

SEQ ID NO: 146973 - RNA, 1410 nt, Artificial Sequence
  derived and/or modified sequence opt3 from neuraminidase__InfluenzaA__AHL98677
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacaccccacagaacucuccugaugaaugaacuuggcguuccuuuucaucuggguaccaaacaggugugcauugcuuggagcaguuccucuugucacgaugggaaggccugguugcaugucugcaucacaggagacgauaagaacgcaaccgccagcuucaucuauaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcaacgcccaacacgucgaggaaugcaguugcuacccacgcuauccggggguuagaugugugugcagggauaauuggaagggaucuaaccggcccauaguagacauuaauaucaaagaucauuccaucgugagcucguacgucuguucuggcuuagugggugacacgccucgcaagaacgacuccucaaguagcucccacugccuggauccaaauaacgaggaagggggacauggcguuaaaggcugggcuuucgacgaugggaaugacguguggaugggacgaaccauuaacgagacaucuagacuugguuacgagacuuuuaaggucaucgaaggcuggagcaaucccaaaucaaaguugcagauuaacaggcaagugauaguagaucguggggaccggaguggauauuccggcaucuucagcguugaggguaaaucuuguauuaaucgcugcuuuuacguggaacugaucagagggaggaaggaggaaaccgagguccuauggacaucaaacaguaucguggucuucuguggcacuagcggaaccuauggcacaggguccuggccugauggagccgaccucaaucugaugccaauuuga

SEQ ID NO: 146974 - RNA, 1410 nt, Artificial Sequence; identical to SEQ ID NO: 145910
  derived and/or modified sequence opt3 from neuraminidase__InfluenzaA__AHL98689

SEQ ID NO: 146975 - RNA, 1410 nt, Artificial Sequence
  derived and/or modified sequence opt3 from neuraminidase__InfluenzaA__AHL98702
augaaccccaaucagaagaucauuaccauaggcagcgugucccugacaaucucuacuauuugcuucuuuaugcaaaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauggccauucaaacaauaccguccgagaucguacacccuauagaacucuccugaugaacgaacuuggugugccuuuucaccuggggaccaagcagguuugcauugcuuggagcaguuccucuugucaugacggaaaagccugguugcacgugugcaucacaggcgaugacaagaaugcaaccgccagcuucaucuacaacggcaggcucgucgauuccgugguaucauggaguaaagagauucugcggacgcaggaaagcgaguguguuugcauaaaugggacuuguacaguggucaugaccgacggaucugcuuccgguaaggcagauacuaaaauccuguuuauugaggaaggcaagaucgugcauacaucaacccucagcgggagugcccaacacguggaggaaugcucuugcuauccacgcuacccgggagucagauguguuugcagggacaacuggaagggcuccaaccggcccauaguggauauuaauaucaaagaccacagcaucguaucgucuuacguguguuccgguuuagucggggacacgccucgcaagaacgauucaaguagcuccucucauugccuggacccaaauaacgaggaaggaggccacggcgugaaagggugggcuuucgaugacggaaaugauguuuggaugggucgaaccauuaacgagacaagcagacuuggcuaugagacuuuuaaggugaucgaaggguggucaaaucccaaaaguaaguugcagauuaacaggcaggucauaguggaccggggagaucguuccggcuacagcgguaucuucucuguagaggggaaaucauguauuaaucgcugcuuuuauguugaacugaucagaggcaggaaggaggaaaccgaggugcuauggacaaguaacagcaucgucguguucuguggaacuuccggcaccuacgggacaggaucuuggccugacggugccgaucucaaucugaugccaauuuga

SEQ ID NO: 146976 - RNA, 1410 nt, Artificial Sequence; identical to SEQ ID NO: 145405
  derived and/or modified sequence opt3 from neuraminidase__InfluenzaA__AHL98714

SEQ ID NO: 146977 - RNA, 1410 nt, Artificial Sequence
  derived and/or modified sequence opt3 from neuraminidase__InfluenzaA__AHL98725
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgggaucuggguaacccgcgagccuuaugugucgugcgauccagacaaguguuaccaauucgcgcugggacagggcacgacucuaaauaacguccauucaaauaacaccgugcgagaucguacacccuauagaacucuccugaugaaugaacuugguguuccuuuucaccuggggaccaaacaggugugcauugcuuggagcaguuccucuugucaugacggaaaggccugguugcacgucugcaucacaggcgaugacaagaacgcaaccgccagcuucaucuacaauggcaggcucguggauuccguaguuucauggaguaaagagauucugcggacgcaggaaagcgagugugugugcauaaacgggacuuguacagucgugaugaccgacggaaacgcuucugguaaggcagauacuaaaauccuguuuauugaggaaggcaagaucgugcauacauccacccucucagggagcgcccaacacgucgaggaaugcaguugcuauccacgcuacccgggaguuagaugugugugcagggacaauuggaagggcucuaaccggcccauaguagauauuaauaucaaagaccacuccaucgugagcucguacgucuguucugguuuagugggggauacgccucgcaagaacgacuccucaaguagcucccauugccuggacccaaauaacgaggaaggaggccacggcguuaaagggugggcuuucgaugacgagaaugauguguggaugggacgaaccauuaacgagacaucuagacuugguuaugaaacuuuuaaggucaucgagggcuggagcaaucccaaaucaaaguugcagauuaacaggcaagugauaguagaccgggggaaucguaguggauacuccggcaucuucagcguugaagguaaaucuuguauuaaccgcugcuuuuauguggagcugaucagagggaggaaggaagagaccgagguccuauggacaucaaauaguaucguggucuucuguggcacuagcggaaccuacggcacaggguccuggccugauggagccgaccucaaccugaugccaauuuga

SEQ ID NO: 146978 - RNA, 1410 nt, Artificial Sequence; identical to SEQ ID NO: 145899
  derived and/or modified sequence opt3 from neuraminidase__InfluenzaA__AHL98737

SEQ ID NO: 146979 - RNA, 1410 nt, Artificial Sequence; identical to SEQ ID NO: 145887
  derived and/or modified sequence opt3 from neuraminidase__InfluenzaA__AHL98749

SEQ ID NO: 146980 - RNA, 1410 nt, Artificial Sequence; identical to SEQ ID NO: 145899
  derived and/or modified sequence opt3 from neuraminidase__InfluenzaA__AHL98761

SEQ ID NO: 146981 - RNA, 1410 nt, Artificial Sequence
  derived and/or modified sequence opt3 from neuraminidase__InfluenzaA__AHL98773
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcaauaucuggguaacccgcgagccuuaugugucgugcgauccagacaaguguuaccaauucgcgcuggggcagggaacgacucuaaacaauguccauucaaacaauaccgcucgagaucguacacccuauagaacucuccugaugaacgaacuuggcgugccuuuucaccuggguaccaagcagguuugcauugccuggagcaguuccucuugucaugacgggaaagcaugguugcacgugugcaucacaggagaugacaagaaugccaccgcuagcuucaucuacaacggcaggcucgucgauuccgugguaucauggaguaaagagauucugcggacgcaggaaagcgaguguguuugcauaaacggcacuuguacaguggucaugaccgacgggucugcauccggaaaggccgauacuaaaauccuguuuauugaggaagguaagaucgugcauacaucaacccucagcggcagugcucaacacguggaggaaugcucuugcuauccacgcuacccgggggucagauguguuugcagggacaauuggaagggauccaaccggcccauaguggauauuaauaucaaagaccacagcaucguaucgucuuacguguguuccggcuuagucggugauacgccucgcaagaacgacucaaguagcuccucucauugccuggacccaaauaacgaggaagggggacacggcgugaaaggcugggccuucgaugacgggaaugauguuuggaugggacgaaccauuaacgagacaagcagacuugguuaugagacuuuuaaggugaucgaaggcuggucaaaucccaaaaguaaguugcagauuaacaggcaggucauaguggaccguggggaucgguccggauacagcggcaucuucucuguagaggguaaaucauguauuaaucgcugcuuuuauguugaacugaucagagggaggaaggaggaaaccgaggugcuauggacaaguaacagcaucgucguguucuguggcacuuccggaaccuacggcacagggucuuggccugacggagcggaucucaaucugaugccaauuuga

SEQ ID NO: 146982 - RNA, 1410 nt, Artificial Sequence; identical to SEQ ID NO: 145919
  derived and/or modified sequence opt3 from neuraminidase__InfluenzaA__AHL98785

SEQ ID NO: 146983 - RNA, 1410 nt, Artificial Sequence
  derived and/or modified sequence opt3 from neuraminidase__InfluenzaA__AHL98797
augaaccccaaucagaagaucauuaccauaggcagcgugucccugacaaucucuacuauuugcuucuuuacgcagaucgccauucucaucaccacagucacucuucacuucaaacaguacgaguuuaacucaccuccaaauaaccagguuaugcugugugaaccgaccauaaucgagagaaauauuacagaaaucguguauuugaccaacacuacaauugagaaggaaaucugccccaaaccugcugaguacaggaauuggaguaagccacagugugggauaaccggauucgcacccuuuagcaaagacaacuccauucgguuaucugccgguggcgauaucuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcauugcuuggagcaguuccucuugucaugaugggaaggccugguugcacgucugcaucaccggagacgauaagaacgcaacggccagcuucaucuacaauggcaggcucguggacuccguaguuucauggaguaaagagauucugcggacucaggaaagcgagugugugugcauaaacggcacauguaccgucgugaugacugaugggucugcuuccggaaaggcagacacaaaaauccuguuuauugaggaagguaagaucgugcauaccucaacgcucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaauuaaugagacuagcagaucagguuaugagaccuuuaaggucaucgaaggcuggaguaaccccaaauccaaacuucagauuaauaggcaagugauaguagaucguggggaccggagcggauacucuggcaucuucucaguugaggguaagaguuguauuaaccgcugcuuuuauguggaauugaucagagggaggaaggaggaaacagagguccuguggacuagcaauuccaucguggucuucuguggcaccucuggaacauacggcaccgggucguggccugauggagccgaccuaaaccucaugccaauuuga

SEQ ID NO: 146984 - RNA, 1410 nt, Artificial Sequence; identical to SEQ ID NO: 144162
  derived and/or modified sequence opt3 from neuraminidase__InfluenzaA__AHL98809

SEQ ID NO: 146985 - RNA, 1410 nt, Artificial Sequence
  derived and/or modified sequence opt3 from neuraminidase__InfluenzaA__AHL98821
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagaucgauguuaccaauucgcgcuggggcagggaacgacucuaaauaacaugcauucaaauaacaccguccgugacagaacacccuauaggacucuccugaugaaugaacuuggcgugccuuuucaccuggguaccaagcagguuugcauugcuuggagcaguuccucuugucaugaugggaaggccugguugcacgugugcaucacaggagacgauaaaaacgcaaccgccagcuucaucuacaauggccggcucgucgacuccgugguaucauggaguaaggagauucugcgcacgcaggaaagcgaguguguuugcauaaacggcacuuguacaguggucaugaccgaugggucugcuuccggaaaagcagacacuaagauccuguuuauugaggaagguaaaaucgugcauacaucaacccucagcggcagugcccaacacguggaggaaugcucuugcuauccaagauacccgggggucagguguguuugccgggauaacuggaagggauccaaucgccccauaguggacauuaacaucaaggaucacagcaucguaucgucuuacguguguuccggcuuagucggugacacgccucgaaagaaugacucaaguagcuccucucauugccuggauccaaacaaugaggaagggggacacggcgugaaaggcugggcuuucgacgaugggaacgacguuuggaugggaagaaccauuaaugagacaagcaggcuugguuaugagacuuuuaaagugaucgaaggcuggucaaaccccaagaguaaauugcagauuaaucggcaggucauaguggaucguggggaccgcuccggauacagcggcaucuucucuguagaggguaagucauguauuaacagaugcuuuuauguugaacugaucagggggcggaaagaggaaaccgaggugcuauggacaaguaauagcaucgucguguucuguggcacuuccggaaccuacggcacagggucuuggccugauggagccgaccucaaccugaugccaauuuga

SEQ ID NO: 146986 - RNA, 1410 nt, Artificial Sequence; identical to SEQ ID NO: 144162
  derived and/or modified sequence opt3 from neuraminidase__InfluenzaA__AHL98833

SEQ ID NO: 146987 - RNA, 1410 nt, Artificial Sequence
  derived and/or modified sequence opt3 from neuraminidase__InfluenzaA__AHL98845
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugauuaacacaaccaucgagaaggaaauaugccccaaaccugcugaguacaggaauuggaguaagccacagugugggauuacuggauucgcacccuuuagcaaagacaacuccauccgguuaucugccgguggcgauauuuggguaacacgcgagccuuaugugucgugcgggccagacaaguguuaccaauucgcgcugggacagggcaccacgcuaaauaacaugcauucaaauaacacuguccgagaucguacccccuauagaacacuccugaugaaugaacuuggugugccuuuucaccuggggacuaagcagguuugcaucgcuuggagcaguuccucuugucaugacggaaaagccugguugcacgugugcaucaccggcgaugacaagaacgcaacagccagcuucauuuacaauggcaggcucgucgauuccgugguaucauggaguaaagagauacugcggacccaggaaagcgaguguguuugcaucaacgggacguguacuguggucaugacagacggaucugcuuccgguaaggcagauaccaaaauucuguuuaucgaggaaggcaagauagugcauacuucaacacucagcgggagugcccaacacguggaggaaugcucuugcuauccacgcuacccgggagucagauguguuugcagggacaacuggaagggcuccaaucggcccauuguggauaucaacaucaaagaccacagcauuguaucgucuuacguguguuccgguuuagucggggauaccccucgcaagaaugacucaaguagcuccucucauugccuggacccaaacaaugaggaaggaggccacggcgugaaagggugggcuuucgaugacggaaacgauguuuggaugggucgaacgaucaaugagaccagcagacuuggcuaugagacauuuaaggugauugaaggguggucaaaccccaaaaguaaguugcagauaaauaggcaggucaucguggaccggggagaucguuccggcuacagcgguauuuucucuguagaggggaaaucauguaucaaccgcugcuuuuauguugaacugaucagaggcaggaaggaggaaacugaggugcuauggaccaguaauagcauugucguguucuguggaacauccggcacuuacgggaccggaucuuggccugacggugccgaucucaaccugaugccaauauga

SEQ ID NO: 146988 - RNA, 1410 nt, Artificial Sequence; identical to SEQ ID NO: 145899
  derived and/or modified sequence opt3 from neuraminidase__InfluenzaA__AHL98857

SEQ ID NO: 146989 - RNA, 1410 nt, Artificial Sequence; identical to SEQ ID NO: 145899
  derived and/or modified sequence opt3 from neuraminidase__InfluenzaA__AHL98869

SEQ ID NO: 146990 - RNA, 1410 nt, Artificial Sequence; identical to SEQ ID NO: 144162
  derived and/or modified sequence opt3 from neuraminidase__InfluenzaA__AHL98881

SEQ ID NO: 146991 - RNA, 1410 nt, Artificial Sequence
  derived and/or modified sequence opt3 from neuraminidase__InfluenzaA__AHL98893
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucuucgaaggcuggucaaaucccaaaaguaaguugcagaucaacaggcaagugauuguagaccguggggaucgguccggauacagcggcauauuuucuguugaggguaaaucauguaucaaucgcugcuucuauguggaacugauuagagggaggaaggaggaaaccgagguccuauggacaaguaacagcaucguggucuucuguggcacuuccggaaccuacggcacagggucuuggccugacggagccgaucucaaucugaugccaaucuga

SEQ ID NO: 146992 - RNA, 1410 nt, Artificial Sequence; identical to SEQ ID NO: 145887
  derived and/or modified sequence opt3 from neuraminidase__InfluenzaA__AHL98905

SEQ ID NO: 146993 - RNA, 1410 nt, Artificial Sequence; identical to SEQ ID NO: 144162
  derived and/or modified sequence opt3 from neuraminidase__InfluenzaA__AHL98916

SEQ ID NO: 146994 - RNA, 1410 nt, Artificial Sequence; identical to SEQ ID NO: 145910
  derived and/or modified sequence opt3 from neuraminidase__InfluenzaA__AHL98928

SEQ ID NO: 146995 - RNA, 1410 nt, Artificial Sequence; identical to SEQ ID NO: 144162
  derived and/or modified sequence opt3 from neuraminidase__InfluenzaA__AHL98940

SEQ ID NO: 146996 - RNA, 1410 nt, Artificial Sequence; identical to SEQ ID NO: 144162
  derived and/or modified sequence opt3 from neuraminidase__InfluenzaA__AHL98952

SEQ ID NO: 146997 - RNA, 1410 nt, Artificial Sequence; identical to SEQ ID NO: 145887
  derived and/or modified sequence opt3 from neuraminidase__InfluenzaA__AHL98964

SEQ ID NO: 146998 - RNA, 1410 nt, Artificial Sequence
  derived and/or modified sequence opt3 from neuraminidase__InfluenzaA__AHL98976
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaguggagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugcuucauggaguaaagaggugcugcggacgcaggaaagcgagugugucugcaucaacggcacuugugcaguggugaugacagaugggucugccuccggaaaggcugacaccaaaauucuguuuauagaggaagguaagaucguccauacuucaacacucagcggcagugcccaacacguugaggaaugcucuugcuauccacgcuacccgggggugagauguguaugcagggauaacuggaagggauccaaucggcccauuguggacaucaacauaaaagaucacagcauugucucgucuuacguguguuccggcuuaguuggugacaccccucgcaagaaugacucaaguagcuccucucauugccuggauccaaacaaugaggaagggggacacggcgugaaaggcugggcguucgacgaugggaacgacgucuggaugggacgaacgaucaaugagaccagcagacuugguuaugagacauuuaaggugaucgaaggcuggucaaaccccaaaaguaaguugcagauuaauaggcagguaaucguugaucguggggaccgguccggauacagcggcauuuucucuguggaggguaaaucauguauaaaccgcugcuuuuaugucgaacugaucagagggaggaaggaggaaacugaggugcuauggaccaguaauagcauugucguguucuguggcacauccggaacuuacggcaccgggucuuggccugauggagcagaccucaaccugaugccaaucuga

SEQ ID NO: 146999 - RNA, 1410 nt, Artificial Sequence; identical to SEQ ID NO: 145887
  derived and/or modified sequence opt3 from neuraminidase__InfluenzaA__AHL98988

SEQ ID NO: 147000 - RNA, 1410 nt, Artificial Sequence; identical to SEQ ID NO: 144162
  derived and/or modified sequence opt3 from neuraminidase__InfluenzaA__AHL99000

SEQ ID NO: 147001 - RNA, 1410 nt, Artificial Sequence; identical to SEQ ID NO: 144162
  derived and/or modified sequence opt3 from neuraminidase__InfluenzaA__AHL99012

SEQ ID NO: 147002 - RNA, 1410 nt, Artificial Sequence
  derived and/or modified sequence opt3 from neuraminidase__InfluenzaA__AHL99024
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagauguauaugcagggauaacuggaagggauccaaucggcccauuguggacaucaacaucaaagaucacagcauuguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccaucaaugagacaagcagacuugguuaugagacuuuuaaggugauugaaggcuggucaaaccccaaaaguaaguugcagauaaauaggcaggucaucguggaucguggggaccgguccggauacagcggcauuuucucuguagaggguaaaucauguaucaaccgcugcuuuuauguugaacugaucagagggaggaaggaggaaaccgaggugcuauggacaaguaauagcauugucguguucuguggcacuuccggaaccuacggcacagggucuuggccugauggagccgaccucaaccugaugccaauauga

SEQ ID NO: 147003 - RNA, 1410 nt, Artificial Sequence; identical to SEQ ID NO: 145380
  derived and/or modified sequence opt3 from neuraminidase__InfluenzaA__AHL99036

SEQ ID NO: 147004 - RNA, 1410 nt, Artificial Sequence; identical to SEQ ID NO: 146802
  derived and/or modified sequence opt3 from neuraminidase__InfluenzaA__AHL99048

SEQ ID NO: 147005 - RNA, 1410 nt, Artificial Sequence; identical to SEQ ID NO: 144162
  derived and/or modified sequence opt3 from neuraminidase__InfluenzaA__AHL99060

SEQ ID NO: 147006 - RNA, 1410 nt, Artificial Sequence
  derived and/or modified sequence opt3 from neuraminidase__InfluenzaA__AHL99072
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaugaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccaucaaugagacaagcagacuugguuaugagacuuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaaccgagguccuauggacaaguaauagcaucguggucuucuguggcacuuccggaaccuacggcacagggucuuggccugauggagccgaccucaaccugaugccaaucuga

SEQ ID NO: 147007 - RNA, 1410 nt, Artificial Sequence
  derived and/or modified sequence opt3 from neuraminidase__InfluenzaA__AHL99084
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagaucgauguuaccaauucgcgcuggggcagggaacgacucuaaauaacaugcauucaaauaacaccguccgugacagaacacccuauaggacucuccugaugaaugaacuuggcgugccuuuucaccuggguaccaagcagguuugcauugcuuggagcaguuccucuugucaugaugggaaggccugguugcacgugugcaucacaggagacgauaaaaacgcaaccgccagcuucaucuacaauggccggcucgucgacuccgugguaucauggaguaaggagauucugcgcacgcaggaaagcgaguguguuugcauaaacggcacuuguacaguggucaugaccgaugggucugcuuccggaaaagcagacacuaagauccuguuuauugaggaagguaaaaucgugcauacaucaacccucagcggcagugcccaacacguggaggaaugcucuugcuauccaagauacccgggggucagguguguuugccgggauaacuggaagggauccaaucgccccauaguggacauuaacaucaaggaucacaauaucguaagcucguacguguguucuggcuuagucggugacacgccucgaaagaacgacuccucaaguagcucccauugccuggauccaaauaacgaggaagggggacacggcgugaaaggcugggcuuucgacgaugggaaugacguuuggaugggaagaaccauuaacgagacaucuaggcuugguuaugagacuuuuaaagugaucgaaggcuggagcaaucccaagucaaaauugcagauuaaccggcaggucauaguggaucguggggaccgcaguggauacuccggcaucuucagcguagaggguaagucuuguauuaauagaugcuuuuauguugaacugaucagggggcggaaagaggaaaccgaggugcuauggacaucaaacaguaucgucguguucuguggcacuagcggaaccuacggcacaggguccuggccugauggagccgaccucaaucugaugccaauuuga

SEQ ID NO: 147008 - RNA, 1410 nt, Artificial Sequence; identical to SEQ ID NO: 144162
  derived and/or modified sequence opt3 from neuraminidase__InfluenzaA__AHL99096

SEQ ID NO: 147009 - RNA, 1410 nt, Artificial Sequence; identical to SEQ ID NO: 144162
  derived and/or modified sequence opt3 from neuraminidase__InfluenzaA__AHL99108

SEQ ID NO: 147010 - RNA, 1410 nt, Artificial Sequence; identical to SEQ ID NO: 144162
  derived and/or modified sequence opt3 from neuraminidase__InfluenzaA__AHL99120

SEQ ID NO: 147011 - RNA, 1410 nt, Artificial Sequence; identical to SEQ ID NO: 144162
  derived and/or modified sequence opt3 from neuraminidase__InfluenzaA__AHL99132

SEQ ID NO: 147012 - RNA, 1410 nt, Artificial Sequence
  derived and/or modified sequence opt3 from neuraminidase__InfluenzaA__AHL99144
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaaggucgcaucgugcauacaucaacccucagcggcagugcccaacacgucgaggaaugcucuugcuauccaagauacccggggguuaggugugugugccgggauaacuggaagggauccaaucgccccauaguagacauuaacaucaaggaucacagcaucgugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggaagaaccauuaaugagacaagcaggcuugguuaugagacuuuuaaagucaucgaaggcuggucaaaccccaagaguaaauugcagauuaaucgacaggugauaguagaucguggggaccgcuccggauacagcggcaucuucucuguugaggguaagucauguauuaacagaugcuuuuauguggaacugaucagggggcggaaagaggaaaccgagguccuauggacaaguaauagcaucguggucuucuguggcacuuccggaaccuacggcacagggucuuggccugauggagccgaccucaaccugaugccaauuuga

SEQ ID NO: 147013 - RNA, 1410 nt, Artificial Sequence; identical to SEQ ID NO: 144162
  derived and/or modified sequence opt3 from neuraminidase__InfluenzaA__AHL99156

SEQ ID NO: 147014 - RNA, 1410 nt, Artificial Sequence
  derived and/or modified sequence opt3 from neuraminidase__InfluenzaA__AHL99168
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaccacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147015 - RNA, 1410 nt, Artificial Sequence; identical to SEQ ID NO: 144162
  derived and/or modified sequence opt3 from neuraminidase__InfluenzaA__AHL99180

SEQ ID NO: 147016 - RNA, 1410 nt, Artificial Sequence; identical to SEQ ID NO: 145026
  derived and/or modified sequence opt3 from neuraminidase__InfluenzaA__AHL99204

SEQ ID NO: 147017 - RNA, 1410 nt, Artificial Sequence
  derived and/or modified sequence opt3 from neuraminidase__InfluenzaA__AHL99216
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuguagagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucauagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaagaaggagaccgaaguccuauggacaaguaauagcaucguggucuucuguggcacuuccggaaccuacggcacagggucuuggccugauggagccgaccucaaccugaugccaauuuga

SEQ ID NO: 147018 - RNA, 1410 nt, Artificial Sequence; identical to SEQ ID NO: 144162
  derived and/or modified sequence opt3 from neuraminidase__InfluenzaA__AHL99228

SEQ ID NO: 147019 - RNA, 1410 nt, Artificial Sequence; identical to SEQ ID NO: 144162
  derived and/or modified sequence opt3 from neuraminidase__InfluenzaA__AHL99240

SEQ ID NO: 147020 - RNA, 1410 nt, Artificial Sequence; identical to SEQ ID NO: 144162
  derived and/or modified sequence opt3 from neuraminidase__InfluenzaA__AHL99252

SEQ ID NO: 147021 - RNA, 1410 nt, Artificial Sequence; identical to SEQ ID NO: 144162
  derived and/or modified sequence opt3 from neuraminidase__InfluenzaA__AHL99264

SEQ ID NO: 147022 - RNA, 1410 nt, Artificial Sequence; identical to SEQ ID NO: 144162
  derived and/or modified sequence opt3 from neuraminidase__InfluenzaA__AHL99276

SEQ ID NO: 147023 - RNA, 1410 nt, Artificial Sequence; identical to SEQ ID NO: 145899
  derived and/or modified sequence opt3 from neuraminidase__InfluenzaA__AHL99288

SEQ ID NO: 147024 - RNA, 1410 nt, Artificial Sequence; identical to SEQ ID NO: 146802
  derived and/or modified sequence opt3 from neuraminidase__InfluenzaA__AHL99300

SEQ ID NO: 147025 - RNA, 1410 nt, Artificial Sequence; identical to SEQ ID NO: 144162
  derived and/or modified sequence opt3 from neuraminidase__InfluenzaA__AHL99312

SEQ ID NO: 147026 - RNA, 1410 nt, Artificial Sequence
  derived and/or modified sequence opt3 from neuraminidase__InfluenzaA__AHL99324
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuauacugugugaaccgacuaucauugagagaaauaucaccgaaauuguguauuugacaaacaccacuaucgagaaggaaauaugccccaaaccugcugaguacaggaauuggaguaagccacagugugggauuacaggauucgcacccuuuagcaaagacaacuccauccgguuaucugccgguggcgauauuuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcaucgcuuggagcaguuccucuugucaugaugggaaggccugguugcacgucugcaucacaggagacgauaagaacgcaaccgccagcuucauuuacaauggcaaacucguggacuccguaguuucauggaguaaggagauacugaggacgcaggaaagcgagugugugugcaucaacggcacuuguacagucgugaugaccgaugggucugcuuccggaaaagcagacacuaagauucuguuuaucgaggaagguaagauagugcauacaucaacccucagcggcagugcccaacacgucgaggaaugcucuugcuauccacgguacccggggguucgcugugugugcagagauaacuggaaaggauccaauaggcccauuguagacaucaacaucaaggaucacagcauugugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggacgcaccaucaaugagacaagccgacuugguuaugagacuuuuaaagucauugaaggcuggucaaaccccaagaguaaauugcagauaaauagacaggugaucguagauaggggagaccgguccggguacagcggcauuuucucuguugaggguaagucauguaucaaccguugcuuuuauguggaacugauccgcgggagaaaggaggaaaccgagguccuauggacaaguaauagcauuguggucuucuguggcacuuccggaaccuacggcacagggucuuggccugauggagccgaccucaaccugaugccaauauga

SEQ ID NO: 147027 - RNA, 1410 nt, Artificial Sequence; identical to SEQ ID NO: 145405
  derived and/or modified sequence opt3 from neuraminidase__InfluenzaA__AHL99348

SEQ ID NO: 147028 - RNA, 1410 nt, Artificial Sequence; identical to SEQ ID NO: 145405
  derived and/or modified sequence opt3 from neuraminidase__InfluenzaA__AHL99359

SEQ ID NO: 147029 - RNA, 1410 nt, Artificial Sequence
  derived and/or modified sequence opt3 from neuraminidase__InfluenzaA__AHL99370
augaaccccaaucagaagaucauuaccauaggcagcgugucccugacaaucacuacgauuugcuucuuuaugcaaaucgccauucucaucaccacagucacucuucacuucaaacaguacgaguuuaacucuccuccaaauaaccagaugaugcugugugaaccgaccauaaucgagagaaauauuacagaaaucguuuauuugaccaacacuacaauugagaaggaaaucugccccaaaccugcugaguacaggaauuggucaaagccacagugugggauaaccggauucgcacccuuuaguaaagacaacagcauucgguuauccgccgguggcgauaucugggugacgcgcgagccuuauguaucuugcgacccagauaaguguuaccaauucgcgcuggggcagggaacuacccuaaauaacgugcauucgaauaacacaguccgagaccguacucccuauagaacccuccugaugaaugaacuuggcgugccuuuucaccuggguacaaagcagguuugcauugcuuggucaagcaguuccugucaugaugggaaagccugguugcacgugugcaucaccggagacgauaagaacgcaacggccucuuucaucuacaauggcaggcucgucgacagcgugguauccuggucaaaagagauucugcggacucaggaaagugaguguguuugcauaaacggcacauguaccguggucaugacugaugggagcgcuucuggaaaggcagacacaaaaauccuguuuauugaggaagguaagaucgugcauaccuccacgcucucaggcagcgcccaacacguggaggaaugcaguugcuauccacgcuacccgggggucagauguguuugcagggauaacuggaagggaucuaaucggcccauaguggacauuaacaucaaagaucacuccaucguaagcucguacguguguucuggcuuagucggugacaccccucgcaagaaugacuccucaaguagcucccauugccuggauccaaacaaugaggaagggggacacggcgugaaaggcugggcuuucgacgaugggaacgacguuuggaugggacgaacaauuaaugagacuucuagacuugguuaugagaccuuuaaggugaucgaaggcuggagcaaccccaaaucaaaguugcagauuaauaggcaggucauaguggaucguggggaccggaguggauacuccggcaucuucagcguagaggguaaaucuuguauuaaccgcugcuuuuauguugaacugaucagagggaggaaggaggaaacagaggugcuauggacuucaaauaguaucgucguguucuguggcaccagcggaacauacggcaccggguccuggccugauggagccgaccucaaccugaugccaauuuga

SEQ ID NO: 147030 - RNA, 1410 nt, Artificial Sequence; identical to SEQ ID NO: 144162
  derived and/or modified sequence opt3 from neuraminidase__InfluenzaA__AHL99393

SEQ ID NO: 147031 - RNA, 1410 nt, Artificial Sequence; identical to SEQ ID NO: 144162
  derived and/or modified sequence opt3 from neuraminidase__InfluenzaA__AHL99417

SEQ ID NO: 147032 - RNA, 1410 nt, Artificial Sequence; identical to SEQ ID NO: 144162
  derived and/or modified sequence opt3 from neuraminidase__InfluenzaA__AHL99429

SEQ ID NO: 147033 - RNA, 1410 nt, Artificial Sequence; identical to SEQ ID NO: 144162
  derived and/or modified sequence opt3 from neuraminidase__InfluenzaA__AHL99441

SEQ ID NO: 147034 - RNA, 1410 nt, Artificial Sequence; identical to SEQ ID NO: 144162
  derived and/or modified sequence opt3 from neuraminidase__InfluenzaA__AHL99453

SEQ ID NO: 147035 - RNA, 1410 nt, Artificial Sequence; identical to SEQ ID NO: 144162
  derived and/or modified sequence opt3 from neuraminidase__InfluenzaA__AHL99477

SEQ ID NO: 147036 - RNA, 1410 nt, Artificial Sequence; identical to SEQ ID NO: 146802
  derived and/or modified sequence opt3 from neuraminidase__InfluenzaA__AHL99489

SEQ ID NO: 147037 - RNA, 1410 nt, Artificial Sequence
  derived and/or modified sequence opt3 from neuraminidase__InfluenzaA__AHL99501
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcacggugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147038 - RNA, 1410 nt, Artificial Sequence; identical to SEQ ID NO: 144162
  derived and/or modified sequence opt3 from neuraminidase__InfluenzaA__AHL99525

SEQ ID NO: 147039 - RNA, 1410 nt, Artificial Sequence
  derived and/or modified sequence opt3 from neuraminidase__InfluenzaA__AHL99537
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacaagcuauagaacucuccugaugaaugaacuuggcguucccuuucaccuggguaccaaacaggugugcauugcuuggaguuccucuagcugucaugaugggaaggccugguugcacgucugcaucacaggagacgauaagaacgcaaccgccuccuucaucuacaauggcaggcucguggacucaguaguuaguuggagcaaagagauucugcggacgcaggaaucugagugugugugcauaaacggcacuuguacagucgugaugaccgauggguccgcuucaggaaaggcagacacuaaaauccuguuuauugaggaagguaagaucgugcauacaagcacccucaguggcucugcccaacacgucgaggaaugcuccugcuauccucgcuacccagggguuagaugugugugcagggauaacuggaagggaagcaaucggccgauaguagacauuaacaucaaagaucacucgaucgugucuuccuacgucuguucaggcuuagugggugacacgccccgcaagaaugacaguagcuccucuagccauugccuggauccuaacaaugaggaagggggacacggcguuaaaggcugggcuuucgacgaugggaacgacguguggaugggacgaaccauuaaugagacaucaagacuugguuaugagacuuuuaaggucaucgaaggcuggaguaacccaaaauccaaguugcagauuaauaggcaagugauaguagaucguggggaccggagcggauacucuggcaucuucucaguugaggguaaaaguuguauuaaccgcugcuuuuauguggaacugaucagagggaggaaggaggaaaccgagguccuauggacaagcaauuccaucguggucuucuguggcacuucuggaaccuacggcacagggucguggcccgauggagccgaccucaaccugaugccuauuuga

SEQ ID NO: 147040 - RNA, 1410 nt, Artificial Sequence; identical to SEQ ID NO: 145899
  derived and/or modified sequence opt3 from neuraminidase__InfluenzaA__AHL99549

SEQ ID NO: 147041 - RNA, 1410 nt, Artificial Sequence; identical to SEQ ID NO: 144162
  derived and/or modified sequence opt3 from neuraminidase__InfluenzaA__AHL99561

SEQ ID NO: 147042 - RNA, 1410 nt, Artificial Sequence
  derived and/or modified sequence opt3 from neuraminidase__InfluenzaA__AHL99573
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuggggagaaggaaauuugccccaaaccugcugaguacaggaauuggaguaagccacaguguggaaucacagguuucgcacccuuuagcaaagacaacuccauacgguuaucugccggcggggauauuuggguaacccgcgagccuuaugugucgugcgacccagauaaguguuaccaauucgcgcugggacagggcacgacucuaaauaacguccauucaaauaacaccgugcgagaccguacacccuauagaacucuccugaugaaugaacuugguguuccuuuucaccuggggaccaaacaggugugcaucgcuuggagcaguuccucuugucaugauggaaaggccugguugcacgucugcauuacaggcgacgauaagaacgcaaccgccagcuucaucuacaauggcaggcucguggacuccguaguuucauggaguaaagagauccugcggacgcaggaaagcgagugugugugcauuaacgggacuuguacagucgugaugaccgauggaucugcuuccgguaaggcagacacuaaaauacuguuuaucgaggaaggcaagauugugcauacaucaacccucagcgggagugcccaacacgucgaggaaugcucuugcuauccacgcuacccgggaguuagaugugugugcagggauaacuggaagggcuccaaucggcccaucauagacauuaacaucaaagaucacagcaucguaucgucuuacguguguuccgguuuagucggggacacgccucgcaagaaugacucaaguagcuccucucauugccuggauccaaacaaugaggaaggaggccacggcgugaaagggugggcuuucgacgauggaaacgacguuuggaugggucgaaccauuaaugagacaagcagacuuggcuaugagacuuuuaaggugaucgaaggguggucaaaccccaaaaguaaguugcagauuaauaggcaggucauaguggauaaaggagaccgguccggcuacagcgguaucuucucuguagaggggaagucauguauuaaccguugcuuuuauguugaacugauccgcggcagaaaggaggaaaccgaggugcuauggacaaguaauagcaucgucguguucuguggaacuuccggcaccuacgggacaggaucuuggccugauggugccgaccucaaccugaugccaauuuga

SEQ ID NO: 147043 - RNA, 1410 nt, Artificial Sequence
  derived and/or modified sequence opt3 from neuraminidase__InfluenzaA__AHL99585
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgcucgagaccguacacccuauagaacucuccugaugaaugaacuuggcgugccuuuucaccuggguaccaagcagguuugcauugccuggagcaguuccucuugucaugaugggaaagcaugguugcacgugugcaucacaggagacgauaagaacgccaccgcuagcuucaucuacaauggcaggcucgucgacuccgugguaucauggaguaaagagauucugcggacgcaggaaagcgaguguguuugcauaaacggcacuuguacaguggucaugaccgaugggucugcauccggaaaggccgacacuaaaauccuguuuauugaggaagguaagaucgugcauacaucaacccucagcggcagugcucaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccugaacccaaauaacgaggaagggggacacggcgugaaaggcugggccuucgaugacgggaaugauguuuggaugggacgaaccauuaacgagacaagcagacuugguuaugagacuuuuaaggugaucgaaggcuggucaaaucccaaaaguaaguugcagauuaacaggcaggucauaguggaccguggggaucgguccggauacagcggcaucuucucuguagaggguaaaucauguauuaaucgcugcuuuuauguugaacugaucagagggaggaaggaggaaaccgaggugcuauggacaaguaacagcaucgucguguucuguggcacuuccggaaccuacggcacagggucuuggccugacggagcggaucucaaucugaugccaauuuga

SEQ ID NO: 147044 - RNA, 1410 nt, Artificial Sequence
  derived and/or modified sequence opt3 from neuraminidase__InfluenzaA__AHL99597
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaauuucgcugugggccagucugucgugucgguuaaacuugcagggaacucaagccugugcccugugaguggaugggccauauacuccaaggacaauucugucagaauuggcagcaaaggugauguguuuguaaucagggagccauucauuuccuguucaccguuggaaugccggaccuuuuucuuaacacagggggcgcugcuaaacgacaagcauaguaauggaaccaucaaagaucgcagccccuaucgaacucucaugucuuguccuaucggcgagguuccaucccccuacaacucacguuuugaaagcguggcuuggagugccucugcaugccacgacggcauuaacuggcugacaauagggaucuccggaccugauagcggugccgucgcugugcuuaaguauaauggcauuaucaccgacacgauaaagucguggagaaacgauauucugaggacucaagagucugagugugcaugcgugaauggguccuguuucaccaucaugacagacggaccaucagauggccaggccaguuacaaaaucuuucggauugaaaaggguaaaaucgucaagagcguugagaugaacgcucccaauuaucauuacgaagagugcuccuguuacccugacucuagcgagauuacuugcgugugccgcgauaacuggcacgggucaaauagaccauggguaaguuucaaccagaauuuggaauaucagauaggauacaucuguuccggcauuuuuggcgacaacccgaggcccaaugauaaaaccgggagcugcggaccugugucuucaaacggugccaauggcgucaagggguucaguuuuaaguauggaaacggcguguggaucggucggacaaaaagcaucuccucucgcaagggguucgagaugauuugggacccaaauggcuggaccggaacggacaacaacuuuucgauaaaacaagauaucguuggcauuaaugaauggagcggguacuccggaucauucgugcagcaucccgagcucacuggucuggacuguauccgaccuugcuucugggucgaacugauuagaggcaggccaaaggagaacacaaucuggaccagugggucuagcauauccuuuuguggaguaaauucagauacugugggcuggagcuggcccgacggugcggagcucccguucacaaucgauaaauga

SEQ ID NO: 147045 - RNA, 1410 nt, Artificial Sequence
  derived and/or modified sequence opt3 from neuraminidase__InfluenzaA__AHL99608
augaaccccaaucagaagaucauuaccauaggcagcgugucccugacaaucucuacuauuugcgucuucaugcaaaucgccauucucaucacgaccguuacacuucacuuuaaacaguacgaguucaacucaccuccaaauaaccaggugaugcugugugaaccgacuauaaucgagagaaauauuaccgaaaucguauauuugacaaacaccacuauugagaaggaaaucugccccaaaccugcugaguacaggaauuggaguaagccacagugugggauaacaggauuugcacccuucagcaaagacaacuccauucgguuaucugccgguggcgauaucugggugacccgcgagccuuaugucucgugcgacccagauaaguguuaccaauuugcgcuggggcagggaacgacucuaaauaacgugcauucaaauaacaccguucgagaccguacacccuauagaacucuccugaugaaugaacuuggcgugccuuuccaccuggguaccaagcaggucugcauugcuuggagcaguuccucuugucaugaugggaaagccugguugcacgugugcaucacaggagacgauaagaacgcaaccgccagcuuuaucuacaauggcaggcucguagacuccguugugucauggaguaaagagauucugcggacgcaggaaagcgagugugucugcauaaacggcacuuguacaguggugaugaccgaugggucugcuuccggaaaggcagacacuaaaauccuguucauugaggaagguaagaucguccauacaucaacccucagcggcagugcccaacacguugaggaaugcucuugcuauccacgcuacccgggggugagauguguaugcagggauaacuggaagggauccaaucggcccauaguggacauuaacaucaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuuugacgaugggaacgacgucuggaugggacgaaccauuaaugagacaagcagacuugguuaugagacuuucaaggugaucgaaggcuggucaaaccccaaaaguaaguugcagauuaauaggcagguaauaguugaucguggggaccgguccggauacagcggcaucuuuucuguggaggguaaaucauguauuaaccgcugcuucuaugucgaacugaucagagggaggaaggaggaaaccgaggugcuauggacaaguaauagcaucgucguguuuuguggcacuuccggaaccuacggcacagggucuuggccugauggagccgaccucaaccugaugccaauuuga

SEQ ID NO: 147046 - RNA, 1410 nt, Artificial Sequence
  derived and/or modified sequence opt3 from neuraminidase__InfluenzaA__AHL99620
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaaacucguggacuccguaguuucauggaguaaggagauucugaggacgcaggaaagcgagugugugugcauaaacggcacuuguacagucgugaugaccgaugggucugcuuccggaaaagcagacacuaagauccuguuuauugaggaagguaagaucgugcauacaucaacccucagcggcagugcccaacacgucgaggaaugcucuugcuauccacgguacccggggguucgcugugugugcagagauaacuggaaaggauccaauaggcccauaguagacauuaacaucaaggaucacagcaucgugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggacgcaccauuaaugagacaagccgacuugguuaugagacuuuuaaagucaucgaaggcuggucaaaccccaagaguaaauugcagauuaauagacaggugauaguagauaggggagaccgguccggguacagcggcaucuucucuguugaggguaagucauguauuaaccguugcuuuuauguggaacugauccgcgggagaaaggaggaaaccgagguccuauggacaaguaauagcaucguggucuucuguggcacuuccggaaccuacggcacagggucuuggccugauggagccgaccucaaccugaugccaauuuga

SEQ ID NO: 147047 - RNA, 1410 nt, Artificial Sequence
  derived and/or modified sequence opt3 from neuraminidase__InfluenzaA__AHL99632
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuaccauagagagaaauaucacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147048 - RNA, 1410 nt, Artificial Sequence; identical to SEQ ID NO: 146837
  derived and/or modified sequence opt3 from neuraminidase__InfluenzaA__AHL99644

SEQ ID NO: 147049 - RNA, 1410 nt, Artificial Sequence
  derived and/or modified sequence opt3 from neuraminidase__InfluenzaA__AHL99668
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuguagagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucauagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 147050 - RNA, 1410 nt, Artificial Sequence; identical to SEQ ID NO: 144162
  derived and/or modified sequence opt3 from neuraminidase__InfluenzaA__AHL99680

SEQ ID NO: 147051 - RNA, 1410 nt, Artificial Sequence
  derived and/or modified sequence opt3 from neuraminidase__InfluenzaA__AHL99692
augaaccccaaucagaagaucauuaccauaggcagcgugucccugacaaucucuacuacgugcuucuuuaugcagauugccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147052 - RNA, 1410 nt, Artificial Sequence; identical to SEQ ID NO: 144162
  derived and/or modified sequence opt3 from neuraminidase__InfluenzaA__AHL99704

SEQ ID NO: 147053 - RNA, 1410 nt, Artificial Sequence; identical to SEQ ID NO: 144162
  derived and/or modified sequence opt3 from neuraminidase__InfluenzaA__AHL99716

SEQ ID NO: 147054 - RNA, 1410 nt, Artificial Sequence; identical to SEQ ID NO: 147044
  derived and/or modified sequence opt3 from neuraminidase__InfluenzaA__AHL99740

SEQ ID NO: 147055 - RNA, 1410 nt, Artificial Sequence
  derived and/or modified sequence opt3 from neuraminidase__InfluenzaA__AHL99751
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuguagagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccgcucgagaccguacacccuauagaacucuccugaugaaugaacuuggcguuccuuuucaccuggguaccaaacaggugugcaucgccuggagcaguuccucuugucaugaugggaaggcaugguugcacgucugcauuacaggagacgauaagaacgccaccgcuagcuucaucuacaauggcaggcucguggacuccguaguuucauggaguaaagagauccugcggacgcaggaaagcgagugugugugcauuaacggcacuuguacagucgugaugaccgaugggucugcauccggaaaggccgacacuaaaauacuguuuaucgaggaagguaagauugugcauacaucaacccucagcggcagugcucaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacacgccucgcaagaaugacucaaguagcuccucucauugccugaacccaaauaacgaggaagggggacacggcguuaaaggcugggccuucgaugacgggaaugauguguggaugggacgaaccaucaacgagacaagcagacuugguuaugagacuuuuaaggucauugaaggcuggucaaaucccaaaaguaaguugcagaucaacaggcaagugauuguagaccguggggaucgguccggauacagcggcauauucucuguugaggguaaaucauguaucaaucgcugcuuuuauguggaacugauuagagggaggaaggaggaaaccgagguccuauggacaaguaacagcaucguggucuucuguggcacuuccggaaccuacggcacagggucuuggccugacggagcggaucucaaucugaugccaaucuga

SEQ ID NO: 147056 - RNA, 1410 nt, Artificial Sequence
  derived and/or modified sequence opt3 from neuraminidase__InfluenzaA__AHL99763
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagaugaauaggcaagugauuguagaucguggggaccgguccggauacagcggcauauucucuguugaggguaaaucauguaucaaccgcugcuuuuauguggaacugauuagagggaggaaggaggaaaccgagguccuauggacaaguaauagcaucguggucuucuguggcacuuccggaaccuacggcacagggucuuggccugauggagccgaccucaaccugaugccaaucuga

SEQ ID NO: 147057 - RNA, 1410 nt, Artificial Sequence; identical to SEQ ID NO: 144162
  derived and/or modified sequence opt3 from neuraminidase__InfluenzaA__AHL99775

SEQ ID NO: 147058 - RNA, 1410 nt, Artificial Sequence
  derived and/or modified sequence opt3 from neuraminidase__InfluenzaA__AHL99787
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccgagaguaaauugcagauuaauaggcaagugauaguagaucguggggaccgguccggauacagcggcaucuucucuguugaagguaagucauguauuaaccgcugcuuuuauguggagcugaucagagggaggaaagaagagaccgagguccuauggacaaguaauagcaucguggucuucuguggcacuuccggaaccuacggcacagggucuuggccugauggagccgaccucaaccugaugccaauuuga

SEQ ID NO: 147059 - RNA, 1410 nt, Artificial Sequence
  derived and/or modified sequence opt3 from neuraminidase__InfluenzaA__AHL99799
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagauguauaugcagggauaacuggaagggauccaaucggcccauuguggacaucaacaucaaagaucacagcauuguaucgucuuacguguguuccggcuuagucggugacacgccucgcaagaaugacucaaguagcuccucucauugccuggggccaaacaaugaggaaggaggccacggcgugaaagggugggcuuucgaugacggaaacgauguuuggaugggucgaaccaucaaugagacaagcagacuuggcuaugagacuuuuaaggugauugaaggguggucaaaccccaaaaguaaguugcagauaaauaggcaggucaucguggaccggggagaucguuccggcuacagcgguauuuucucuguagaggggaaaucauguaucaaccgcugcuuuuauguugaacugaucagaggcaggaaggaggaaaccgaggugcuauggacaaguaauagcauugucguguucuguggaacuuccggcaccuacgggacaggaucuuggccugacggugccgaucucaaccugaugccaauauga

SEQ ID NO: 147060 - RNA, 1410 nt, Artificial Sequence; identical to SEQ ID NO: 144162
  derived and/or modified sequence opt3 from neuraminidase__InfluenzaA__AHL99811

SEQ ID NO: 147061 - RNA, 1410 nt, Artificial Sequence
  derived and/or modified sequence opt3 from neuraminidase__InfluenzaA__AHL99823
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuugugcugucgugaugacagaugggucugcauccggaaaggccgacaccaaaauccuguuuauugaggaagguaagaucgugcauacuucaacacucagcggcagugcucaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacaccccucgcaagaaugacucaaguagcuccucucauugccuggauccaaacaaugaggaagggggacacggcguuaaaggcugggccuucgacgaugggaacgacguguggaugggacgaacgauuaaugagaccagcagacuugguuaugagacauuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaacugagguccuauggaccaguaauagcaucguggucuucuguggcacauccggaacuuacggcaccgggucuuggccugauggagcggaccucaaccugaugccaauuuga

SEQ ID NO: 147062 - RNA, 1410 nt, Artificial Sequence
  derived and/or modified sequence opt3 from neuraminidase__InfluenzaA__AHL99835
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgcgccagacaaguguuaccaauucgcucuggggcagggaacgacucuaaauaacguccauucaaauaacaccgugcgagaucguacacccuauagaacucuccugaugaaugaacuuggcguuccuuuucaccuggguaccaaacaggugugcauugccuggagcaguuccucuugucaugacgggaaggcaugguugcacgucugcaucacaggagaugacaagaacgccaccgcuagcuucaucuacaauggcaggcucguggauuccguaguuucauggaguaaagagauucugcggacgcaggaaagcgagugugugugcauaaacggcacuuguacagucgugaugaccgacgggucugcauccggaaaggccgauacuaaaauccuguuuauugaggaagguaagaucgugcauacaucaacccucagcggcagugcucaacacgucgaggaaugcucuugcuauccacgcuacccggggguuagaugugugugcagggacaacuggaagggauccaaucggcccauaguagauauuaacaucaaagaccacagcaucgugucgucuuacgucuguuccggcuuagugggugauacgccucgcaagaaugacucaaguagcuccucucauugccuggacccaaacaaugaggaagggggacacggcguuaaaggcugggccuucgaugacgggaacgauguguggaugggacgaaccauuaaugagacaagcagacuugguuaugagacuuuuaaggucaucgaaggcuggucaaaccccaaaaguaaguugcugauuaauaggcaagugauaguagaccguggggaucgguccggauacagcggcaucuucucuguugaggguaaaucauguauuaaccgcugcuuuuauguggaacuaaucagagggaggaaggaggaaaccgagguccucuggacaaguaauagcaucguggucuucuguggcacuuccggaaccuacggcacagggucuuggccugacggagcggaucugaaccuuaugccaauuuga

SEQ ID NO: 147063 - RNA, 1410 nt, Artificial Sequence; identical to SEQ ID NO: 144162
  derived and/or modified sequence opt3 from neuraminidase__InfluenzaA__AHL99847

SEQ ID NO: 147064 - RNA, 1410 nt, Artificial Sequence; identical to SEQ ID NO: 145391
  derived and/or modified sequence opt3 from neuraminidase__InfluenzaA__AHL99859

SEQ ID NO: 147065 - RNA, 1410 nt, Artificial Sequence
  derived and/or modified sequence opt3 from neuraminidase__InfluenzaA__AHL99871
augaaccccaaucagaagaucauuaccauaggcagcgugucccugacaaucucuacuauuugcuucuuuaugcaaaucgccauucucacgaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugacaucaccggguucgcacccuuuagcaaagauaacuccauacgguuaucugccggaggugacauuuggguaacgcgcgagccuuaugugucgugcgauccagacaaguguuaccaauucgcgcugggccaggggacuacccuaaauaacguccauucaaauaacacagugcgagaucguacucccuauagaacccuccugaugaaugaacuuggaguuccuuuucaccugggcacaaaacaggugugcaucgcuuggagcaguuccucuugucaugacgguaaagccugguugcacgucugcauuaccggggaugacaagaacgcaacggccagcuucaucuacaauggaaggcucguggauuccguaguuucauggaguaaagagauccugcggacucaggaaagcgagugugugugcauuaacggcacauguaccgucgugaugacugacggcucugcuuccgggaaggcagauacaaaaauacuguuuaucgaggaaggacgcauugugcauaccucaacgcucagcgguagugcccaacacgucgaggaaugcucuugcuauccaagauacccgggcguuaggugugugugccgggacaacuggaagggguccaaucgccccaucguagauauaaacauuaaggaccacagcaucgugucgcgauacgucuguucuggauuagugggcgacaccccuagaaagaaugauuccucaaguagcucccauugccuggacccaaacaaugaggaaggugggcacggaguuaagggcugggcuuucgaugacggcaacgauguguggauggggaggacaaucaaugagacuucucggcuuggauaugagaccuuuaaagucauugaagguuggagcaaccccaagucaaaauugcagaucaaucgucaggugauuguagaccgcggcgauagaaguggguacuccggaauauucagcguugagggcaagucuuguaucaacaggugcuuuuauguggaacugauucggggucgaaaagaggaaacagagguccuauggacuucaaauaguaucguggucuucugugggaccagcggcacauacggaaccggcuccuggccugacggggccgaucucaaccugaugccaaucuga

SEQ ID NO: 147066 - RNA, 1410 nt, Artificial Sequence; identical to SEQ ID NO: 144162
  derived and/or modified sequence opt3 from neuraminidase__InfluenzaA__AHL99883

SEQ ID NO: 147067 - RNA, 1410 nt, Artificial Sequence; identical to SEQ ID NO: 147043
  derived and/or modified sequence opt3 from neuraminidase__InfluenzaA__AHL99895

SEQ ID NO: 147068 - RNA, 1410 nt, Artificial Sequence; identical to SEQ ID NO: 144162
  derived and/or modified sequence opt3 from neuraminidase__InfluenzaA__AHL99907

SEQ ID NO: 147069 - RNA, 1410 nt, Artificial Sequence; identical to SEQ ID NO: 144162
  derived and/or modified sequence opt3 from neuraminidase__InfluenzaA__AHL99919

SEQ ID NO: 147070 - RNA, 1410 nt, Artificial Sequence
  derived and/or modified sequence opt3 from neuraminidase__InfluenzaA__AHL99943
augaaccccaaucagaagaucauuaccauaggcagcgugucccugacaaucucuacuauuugcuucuuuaugcagaucgccauucucaucacgaccgucacacuucacuucaaacagcaugaguuuaacucaccuccaaauaaccagguuaugcugugugaaccgacuauaaucgagagaaauauuaccgaaaucguguacuugacaaacaccacuauugagaaggaaaucugccccaaaccugcugaguauaggaauuggaguaagccacagugugggauaacaggauucgcacccuuuagcaaagacaacuccauucgguuaucugccgguggcgauaucuggguaacccgcgagccuuacgugucgugcgacccagauaaguguuaucaauucgcgcuggggcagggaacgacucuaaauaacguccacucaaauaacaccgugcgagaccguacacccuacagaacucuccugaugaaugaacuuggcguuccuuuucaucuggguaccaaacaggugugcauugcuuggagcaguuccucuugucacgaugggaaggccugguugcaugucugcaucacaggagacgauaagaacgcaaccgccagcuucaucuauaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcagugcccaacacgucgaggaaugcucuugcuacccacgcuauccggggguuagaugugugugcagggauaacuggaagggauccaaucggcccauaguagacauuaacaucaaagaucauagcaucgugucgucuuacgucuguuccggcuuagugggugacacgccucgcaagaaugacucaaguagcuccucucacugccuggauccaaacaaugaggaagggggacauggcguuaaaggcugggcuuucgacgaugggaacgacguguggaugggacgaaccauuaaugagacaagcagacuugguuacgagacuuuuaaggucaucgaaggcuggucaaaccccaaaaguaaguugcagauuaauaggcaagugauaguagaucguggggaccgguccggauauagcggcaucuucucuguugaggguaaaucauguauuaaccgcugcuuuuacguggaacugaucagagggaggaaggaggaaaccgagguccuauggacaaguaauagcaucguggucuucuguggcacuuccggaaccuauggcacagggucuuggccugauggagccgaccucaaccugaugccaauuuga

SEQ ID NO: 147071 - RNA, 1410 nt, Artificial Sequence; identical to SEQ ID NO: 144162
  derived and/or modified sequence opt3 from neuraminidase__InfluenzaA__AHL99955

SEQ ID NO: 147072 - RNA, 1410 nt, Artificial Sequence
  derived and/or modified sequence opt3 from neuraminidase__InfluenzaA__AHL99967
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcacgaccgaacacccuaucguacucuccugaugaaugaacuuggcguuccuuuucaucuggguaccaaacaggugugcauugcuuggagcaguuccucuugucacgaugggaaggccugguugcaugucugcaucacaggagacgauaagaacgcaaccgccagcuucaucuacaauggcagacucguggacuccguaguuucauggaguaaagagauucugaggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcagugcccaacacgucgaggaaugcucuugcuauccacgguacccggggguucgcugugugugcagagauaacuggaagggauccaauaggcccauaguagacauuaacaugaaagaucauagcaucgugucgucuuacgucuguuccggcuuagugggugacacgccucggaagaaugacucaaguagcuccucucacugccuggauccaaacaaugaggaagggggacauggcguuaaaggcugggcuuucgacgaugggaacgacguguggaugggacgcaccaucaaugagacaagccgacuugguuaugagacuuuuaaggucauugaaggcuggucaaaccccaaaaguaaguugcagaucaauagacaggugauuguagauaggggagaccgguccggguacagcggcauauucucuguugaggguaaaucauguaucaaccguugcuuuuauguggaacugauucgcgggagaaaggaggaaaccgagguccuauggacaaguaauagcaucguggucuucuguggcacuuccggaaccuacggcacagggucuuggccugauggagccgaccucaaccugaugccaaucuga

SEQ ID NO: 147073 - RNA, 1410 nt, Artificial Sequence
  derived and/or modified sequence opt3 from neuraminidase__InfluenzaA__AHL99979
augaaccccaaucagaagaucauuaccauaggcagcgugucccugacaaucucuacuauuugcuucuuuaugcagaucgccauucucaucacgaccgucgcacuucacuucaaacagcaugaguuuaacucaccuccaaauaaccagguuaugcugugugaaccgacaauaaucgagagaaauauuacugaaaucguguacuugaccaacacaaccauugagaaggaaaucugccccaaaccugcugaguauaggaauuggaguaagccacagugugggauaacuggauucgcccccuuuagcaaagacaacuccauucgguuaucugcggguggcgauaucuggguaacacgcgagccuuacgugucgugcgacccagauaaguguuaucaauucgcucuggggcagggaaccacgcuaaauaacguccacucaaauaacacugugcgagaccguacccccuacagaacacuccugaugaaugaacuuggcguuccuuuucaucuggguacuaaacaggugugcauugccuggagcaguuccucuugucacgaugggaaggcaugguugcaugucugcaucaccggagacgauaagaacgccacagcuagcuucaucuauaauggcaggcucguggacuccguaguuucauggaguaaagagauucugcggacccaggaaagcgagugugugugcauaaacggcacguguacugucgugaugacagaugggucugcauccggaaaggccgacaccaaaauccuguuuauugaggaagguaagaucgugcacacuucaacacucagcggcagugcucaacacgucgaggaaugcucuugcuacccacgcuauccggggguuagaugugugugcagggauaacuggaagggauccaaucggcccauaguagacauuaacaucaaagaucauagcaucgugucgucuuacgucuguuccggcuuagugggugacaccccucgcaagaaugacucaaguagcuccucucacugccuggauccaaacaaugaggaagggggacauggcguuaaaggcugggccuucgacgaugggaacgacguguggaugggacgaacgauuaaugagaccagcagacuugguuacgagacauuuaaggucaucgaaggcuggucaaaccccaaaaguaaguugcagauuaauaggcaagugauaguagaucguggggaccgguccggauauagcggcaucuucucuguugaggguaaaucauguauuaaccgcugcuuuuacguggaacugaucagagggaggaaggaggaaacugagguccuauggaccaguaauagcaucguggucuucuguggcacauccggaacuuauggcaccgggucuuggccugauggagcggaccucaaccugaugccaauuuga

SEQ ID NO: 147074 - RNA, 1410 nt, Artificial Sequence; identical to SEQ ID NO: 147070
  derived and/or modified sequence opt3 from neuraminidase__InfluenzaA__AHL99991

SEQ ID NO: 147075 - RNA, 1410 nt, Artificial Sequence; identical to SEQ ID NO: 144162
  derived and/or modified sequence opt3 from neuraminidase__InfluenzaA__AHM00004

SEQ ID NO: 147076 - RNA, 1410 nt, Artificial Sequence; identical to SEQ ID NO: 144162
  derived and/or modified sequence opt3 from neuraminidase__InfluenzaA__AHM00016

SEQ ID NO: 147077 - RNA, 1410 nt, Artificial Sequence; identical to SEQ ID NO: 144162
  derived and/or modified sequence opt3 from neuraminidase__InfluenzaA__AHM00028

SEQ ID NO: 147078 - RNA, 1410 nt, Artificial Sequence; identical to SEQ ID NO: 147070
  derived and/or modified sequence opt3 from neuraminidase__InfluenzaA__AHM00040

SEQ ID NO: 147079 - RNA, 1410 nt, Artificial Sequence; identical to SEQ ID NO: 144162
  derived and/or modified sequence opt3 from neuraminidase__InfluenzaA__AHM00052

SEQ ID NO: 147080 - RNA, 1410 nt, Artificial Sequence; identical to SEQ ID NO: 145026
  derived and/or modified sequence opt3 from neuraminidase__InfluenzaA__AHM00064

SEQ ID NO: 147081 - RNA, 1410 nt, Artificial Sequence; identical to SEQ ID NO: 144162
  derived and/or modified sequence opt3 from neuraminidase__InfluenzaA__AHM00076

SEQ ID NO: 147082 - RNA, 1410 nt, Artificial Sequence; identical to SEQ ID NO: 144162
  derived and/or modified sequence opt3 from neuraminidase__InfluenzaA__AHM00088

SEQ ID NO: 147083 - RNA, 1410 nt, Artificial Sequence
  derived and/or modified sequence opt3 from neuraminidase__InfluenzaA__AHM00100
augaaccccaaucagaagaucauuaccauaggcagcaucugcaugacaauugggauggccaaccugauccuccaaauuggaaauaucauauccaucuggauuucucacucaauccagcuugguaaccagagucagauugagacuuguaaucaaagcgugaucacguacgaaaacaauaccugggucaaccagacauauguuaauauauccaacacuaauuucgcugcaggccagucugugguaucggugaaacuggccgggaacagcagcuugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcguuauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuacuaaacaagacaucgugggcauuaaugaauggucgggguacagcggauccuucguccagcaucccgagcugacaggucuggauuguauccgaccuugcuucuggguggaacucauuagaggcaggccaaaggagaacaccaucuggacuucagggaguucuauaucauuuuguggaguuaauuccgacacagugggcuggucauggcccgauggugcagaguuaccguucaccaucgacaacuga

SEQ ID NO: 147084 - RNA, 1410 nt, Artificial Sequence; identical to SEQ ID NO: 147006
  derived and/or modified sequence opt3 from neuraminidase__InfluenzaA__AHM00111

SEQ ID NO: 147085 - RNA, 1410 nt, Artificial Sequence; identical to SEQ ID NO: 147070
  derived and/or modified sequence opt3 from neuraminidase__InfluenzaA__AHM00123

SEQ ID NO: 147086 - RNA, 1410 nt, Artificial Sequence; identical to SEQ ID NO: 145391
  derived and/or modified sequence opt3 from neuraminidase__InfluenzaA__AHM00135

SEQ ID NO: 147087 - RNA, 1410 nt, Artificial Sequence; identical to SEQ ID NO: 145899
  derived and/or modified sequence opt3 from neuraminidase__InfluenzaA__AHM00147

SEQ ID NO: 147088 - RNA, 1410 nt, Artificial Sequence; identical to SEQ ID NO: 147070
  derived and/or modified sequence opt3 from neuraminidase__InfluenzaA__AHM00159

SEQ ID NO: 147089 - RNA, 1410 nt, Artificial Sequence; identical to SEQ ID NO: 144162
  derived and/or modified sequence opt3 from neuraminidase__InfluenzaA__AHM00171

SEQ ID NO: 147090 - RNA, 1410 nt, Artificial Sequence; identical to SEQ ID NO: 144162
  derived and/or modified sequence opt3 from neuraminidase__InfluenzaA__AHM00183

SEQ ID NO: 147091 - RNA, 1410 nt, Artificial Sequence
  derived and/or modified sequence opt3 from neuraminidase__InfluenzaA__AHM00195
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaagugcuguuuaucgaggaaggaaagauuguccauacaucaacccucagcgguagugcccaacacguugaggaaugcucuugcuauccacgcuacccgggcgugagauguguaugcagggacaacuggaagggguccaaucggcccaucguggauauaaacauuaaagaccacagcaucgucucgcgcuacguguguucuggauuaguuggcgacacgccucgaaagaaugauuccucaaguagcucccauugccuggacccaaacaaugaggaaggugggcacggagugaaaggcugggcuuucgaugacggcaacgaugucuggauggggagaaccaucaaugagacaucuaggcuuggauaugagacuuuuaaggugauugaagguuggagcaaccccaaaucaaaguugcagaucaaucggcagguaauuguugaccguggcgaucgcaguggguacuccggaauauucagcguggagggcaaaucuuguaucaacagaugcuuuuaugucgaacugauuaggggucggaaggaggaaaccgaggugcuauggacaucaaauaguaucgucguguucugugggacuagcggcaccuacggaacaggcuccuggccugacggggccgaucucaaccugaugccaaucuga

SEQ ID NO: 147092 - RNA, 1410 nt, Artificial Sequence
  derived and/or modified sequence opt3 from neuraminidase__InfluenzaA__AHM00207
augaaccccaaucagaagaucauuaccauaggcagcgugucccugacaaucucuacuauuugcuucuuuaugcagaucgccauucucaucacgaccgucacacuucacuucaaacagcaugaguuuaacucaccuccaaauaaccagguuaugcugugugaaccgacuauaaucgagagaaauauuaccgaaaucguguacuugacaaacaccacuauugagaaggaaaucugccccaaaccugcugaguauaggaauuggaguaagccacagugugggauaacaggauucgcacccuuuagcaaagacaacuccauucgguuaucugccgguggcaauaucuggguaacccgcgagccuuacgugucgugcgauccagacaaguguuaucaauucgcgcuggggcagggaacgacucuaaacaauguccacucaaacaauaccgugcgagaucguacacccuacagaacucuccugaugaacgaacuuggcguuccuuuucaucuggguaccaaacaggugugcauugcuuggagcaguuccucuugucacgacgggaaggccugguugcaugucugcaucacaggagaugacaagaaugcaaccgccagcuucaucuauaacggcaggcucguggauuccguaguuucauggaguaaagagauucugcggacgcaggaaagcgagugugugugcauaaacggcacuuguacagucgugaugaccgacgggucugcuuccggaaaggcagauacuaaaauccuguuuauugaggaagguaagaucgugcacacaucaacccucagcggcagugcccaacacgucgaggaaugcucuugcuacccacgcuauccggggguuagaugugugugcagggacaauuggaagggauccaaccggcccauaguagauauuaauaucaaagaccauagcaucgugucgucuuacgucuguuccggcuuagugggugauacgccucgcaagaacgacucaaguagcuccucucacugccuggacccaaauaacgaggaagggggacauggcguuaaaggcugggcuuucgaugacgggaaugauguguggaugggacgaaccauuaacgagacaagcagacuugguuacgagacuuuuaaggucaucgaaggcuggucaaaucccaaaaguaaguugcagauuaacaggcaagugauaguagaccguggggaucgguccggauauagcggcaucuucucuguugaggguaaaucauguauuaaucgcugcuuuuacguggaacugaucagagggaggaaggaggaaaccgagguccuauggacaaguaacagcaucguggucuucuguggcacuuccggaaccuauggcacagggucuuggccugacggagccgaucucaaucugaugccaauuuga

SEQ ID NO: 147093 - RNA, 1410 nt, Artificial Sequence; identical to SEQ ID NO: 147070
  derived and/or modified sequence opt3 from neuraminidase__InfluenzaA__AHM00219

SEQ ID NO: 147094 - RNA, 1410 nt, Artificial Sequence; identical to SEQ ID NO: 144162
  derived and/or modified sequence opt3 from neuraminidase__InfluenzaA__AHM00231

SEQ ID NO: 147095 - RNA, 1410 nt, Artificial Sequence; identical to SEQ ID NO: 144162
  derived and/or modified sequence opt3 from neuraminidase__InfluenzaA__AHM00243

SEQ ID NO: 147096 - RNA, 1410 nt, Artificial Sequence; identical to SEQ ID NO: 144162
  derived and/or modified sequence opt3 from neuraminidase__InfluenzaA__AHM00255

SEQ ID NO: 147097 - RNA, 1410 nt, Artificial Sequence
  derived and/or modified sequence opt3 from neuraminidase__InfluenzaA__AHM00267
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguagcuucauggaguaaagagauucugcggacgcaggaaagcgaguguguuugcauaaacggcacuuguacaguggucaugaccgaugggucugcauccggaaaggccgacacuaaaauccuguuuauugaggaagguaagaucgugcauacaucaacccucagcggcagugcucaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggccuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagcggaccucaaccugaugccaauuuga

SEQ ID NO: 147098 - RNA, 1410 nt, Artificial Sequence; identical to SEQ ID NO: 145391
  derived and/or modified sequence opt3 from neuraminidase__InfluenzaA__AHM00279

SEQ ID NO: 147099 - RNA, 1410 nt, Artificial Sequence; identical to SEQ ID NO: 144162
  derived and/or modified sequence opt3 from neuraminidase__InfluenzaA__AHM00291

SEQ ID NO: 147100 - RNA, 1410 nt, Artificial Sequence; identical to SEQ ID NO: 144162
  derived and/or modified sequence opt3 from neuraminidase__InfluenzaA__AHM00303

SEQ ID NO: 147101 - RNA, 1410 nt, Artificial Sequence; identical to SEQ ID NO: 144162
  derived and/or modified sequence opt3 from neuraminidase__InfluenzaA__AHM00315

SEQ ID NO: 147102 - RNA, 1410 nt, Artificial Sequence; identical to SEQ ID NO: 145391
  derived and/or modified sequence opt3 from neuraminidase__InfluenzaA__AHM00327

SEQ ID NO: 147103 - RNA, 1410 nt, Artificial Sequence; identical to SEQ ID NO: 145391
  derived and/or modified sequence opt3 from neuraminidase__InfluenzaA__AHM00339

SEQ ID NO: 147104 - RNA, 1410 nt, Artificial Sequence; identical to SEQ ID NO: 147070
  derived and/or modified sequence opt3 from neuraminidase__InfluenzaA__AHM00351

SEQ ID NO: 147105 - RNA, 1410 nt, Artificial Sequence; identical to SEQ ID NO: 147006
  derived and/or modified sequence opt3 from neuraminidase__InfluenzaA__AHM00363

SEQ ID NO: 147106 - RNA, 1410 nt, Artificial Sequence
  derived and/or modified sequence opt3 from neuraminidase__InfluenzaA__AHM00375
augaaccccaaucagaagaucauuaccauaggcagcgugucccugacaaucucuacuauuugcuucuuuaugcaaaucgccauucucaucacgaccgucacacuucacuucaaacagcaugaguuuaacucaccuccaaauaaccagguuaugcugugugaaccgacuauaaucgagagaaauauuaccgaaaucguguacuugacaaacaccacuauugagaaggaaguaugccccaaaccugcugaguauaggaauuggaguaagccacagugugggaucacaggauucgcacccuuuagcaaagacaacuccauacgguuaucugccgguggcgauauuugggugacccgcgagccuuacgucucgugcgacccagauaaguguuaucaauucgcgcuggggcagggaacgacucuaaauaacgugcacucaaauaacaccguucgagaccguacacccuacagaacucuccugaugaaugaacuuggcgugccuuuucaucuggguaccaagcaggucugcaucgcuuggagcaguuccucuugucacgaugggaaagccugguugcaugugugcauuacaggagacgauaagaacgcaaccgccagcuucaucuauaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccacacaucaacccucagcggcagugcccaacacguugaggaaugcucuugcuacccacgcuauccgggggugagauguguaugcagggauaacuggaagggauccaaucggcccaucguggacauaaacauuaaagaucauagcaucgucucgucuuacguguguuccggcuuaguuggugacacgccucgcaagaaugacucaaguagcuccucucacugccuggauccaaacaaugaggaagggggacauggcgugaaaggcugggcuuucgacgaugggaacgacgucuggaugggacgaaccaucaaugagacaagcagacuugguuacgagacuuuuaaggugauugaaggcuggucaaaccccaaaaguaaguugcagaucaauaggcagguaauuguugaucguggggaccgguccggauauagcggcauauucucuguggaggguaaaucauguaucaaccgcugcuuuuacgucgaacugauuagagggaggaaggaggaaaccgaggugcuauggacaaguaauagcaucgucguguucuguggcacuuccggaaccuauggcacagggucuuggccugauggagccgaccucaaccugaugccaaucuga

SEQ ID NO: 147107 - RNA, 1410 nt, Artificial Sequence
  derived and/or modified sequence opt3 from neuraminidase__InfluenzaA__AHM00398
augaaccccaaucagaagaucauuaccauaggcagcgugucccugacaaucucuacuauuugcuucuuuaugcagaucgccauucucaucacgaccgucacacuucacuucaaacagcaugaguuuaacucaccuccaaauaaccagguuaugcugugugaaccgacuauaaucgagagaaauauuaccgaaaucguguacuugacaaacaccacuauugagaaggaaaucugccccaaaccugcugaguauaggaauuggaguaagccacagugugggauaacaggauucgcacccuuuagcaaagagaacuccauucgguuaucugccgguggcgacaucuggguaacccgcgaaccuuacgugucgugcgauccagacaaguguuaucaauucgcgcuggggcagggaacgacucuaaauaacguccacucaaauaacaccgugcgagaucguacacccuacagaacucuccugaugaaugagcuuggcguuccuuuucaucuggguaccaaacaggugugcauugcuuggagcaguuccucuugucacgacgggaaggccugguugcaugucugcaucacaggagaugacaagaacgcaaccgccagcuucaucuauaauggcaggcucguggauuccguaguuucauggaguaaagaaauucugcggacgcaggagagcgagugugugugcauaaacggcacuuguacagucgugaugaccgacgggucugcuuccggaaaggcagauacuaaaauccuguuuauugaagaggguaagaucgugcacacaucaacccucagcggcagugcccaacacgucgaagagugcucuugcuacccacgcuauccggggguuagaugugugugcagggacaacuggaagggauccaaucggcccauaguagauauuaacaucaaagaccauagcaucgugucgucuuacgucuguuccggcuuagugggugauacgccucgcaagaaugacucaaguagcuccucucacugccuggacccaaacaaugaagaagggggacauggcguuaaaggcugggcuuucgaugacgggaacgauguguggaugggacgaaccauuaaugagacaagcagacuugguuacgagacuuuuaaggucaucgagggcuggucaaaccccaaaaguaaguugcagauuaauaggcaagugauaguagaccguggggaucgguccggauauagcggcaucuucucuguugaagguaaaucauguauuaaccgcugcuuuuacguggagcugaucagagggaggaaggaagagaccgagguccuauggacaaguagcuccaucguggucuucuguggcacuucuggaaccuauggcacagggucguggccugacggagccgaucucaaucugaugccaauuuga

SEQ ID NO: 147108 - RNA, 1410 nt, Artificial Sequence; identical to SEQ ID NO: 144162
  derived and/or modified sequence opt3 from neuraminidase__InfluenzaA__AHM00410

SEQ ID NO: 147109 - RNA, 1410 nt, Artificial Sequence
  derived and/or modified sequence opt3 from neuraminidase__InfluenzaA__AHM00422
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 147110 - RNA, 1410 nt, Artificial Sequence
  derived and/or modified sequence opt3 from neuraminidase__InfluenzaA__AHM00434
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaaccagcugaguacaggaauuggucaaagccccagugugggauaacaggauucgcaccuuuuaguaaagacaacagcauucgguuauccgccgguggcgauaucuggguaacccgcgagccauaugugucuugcgaccccgauaaguguuaccaauucgcgcuggggcagggaacgacucuaaauaacguccauucgaauaacaccgugcgagaccguacaccuuauagaacucuccugaugaaugaacuuggcguuccauuucaccuggguaccaaacaggugugcauugcuuggucaagcaguuccugucaugaugggaaggccugguugcacgucugcaucacaggagacgauaagaacgcaaccgccucuuucaucuacaauggcaggcucguggacagcguaguuuccuggucaaaagagauucugcggacgcaggaaagugagugugugugcauaaacggcacuuguacagucgugaugaccgaugggagcgcuucuggaaaggcagacacuaaaauccuguuuauugaggaagguaagaucgugcauacauccacccucucaggcagcgcccaacacgucgaggaaugcaguugcuauccgcgcuaccccgggguuagaugugugugcagggauaacuggaagggaucuaaucggccuauaguagacauuaacaucaaagaucacuccaucgugagcucguacgucuguucuggcuuagugggugacacgccacgcaagaaugacuccucaaguagcucccauugccuggaucccaacaaugaggaagggggacacggcguuaaaggcugggcuuucgacgaugggaacgacguguggaugggacgaaccauuaaugagacaucuagacuugguuaugagacuuuuaaggucaucgaaggcuggagcaacccuaaaucaaaguugcagauuaauaggcaagugauaguagaucguggggaccggaguggauacuccggcaucuucagcguugaggguaaaucuuguauuaaccgcugcuuuuauguggaacugaucagagggaggaaggaggaaaccgagguccuauggacaucaaauaguaucguggucuucuguggcacuagcggaaccuacggcacaggguccuggccagauggagccgaccucaaccugaugcccauuuga

SEQ ID NO: 147111 - RNA, 1410 nt, Artificial Sequence; identical to SEQ ID NO: 144162
  derived and/or modified sequence opt3 from neuraminidase__InfluenzaA__AHM00446

SEQ ID NO: 147112 - RNA, 1410 nt, Artificial Sequence; identical to SEQ ID NO: 147070
  derived and/or modified sequence opt3 from neuraminidase__InfluenzaA__AHM00458

SEQ ID NO: 147113 - RNA, 1410 nt, Artificial Sequence; identical to SEQ ID NO: 147070
  derived and/or modified sequence opt3 from neuraminidase__InfluenzaA__AHM00470

SEQ ID NO: 147114 - RNA, 1410 nt, Artificial Sequence; identical to SEQ ID NO: 147070
  derived and/or modified sequence opt3 from neuraminidase__InfluenzaA__AHM00482

SEQ ID NO: 147115 - RNA, 1410 nt, Artificial Sequence; identical to SEQ ID NO: 147070
  derived and/or modified sequence opt3 from neuraminidase__InfluenzaA__AHM00494

SEQ ID NO: 147116 - RNA, 1410 nt, Artificial Sequence
  derived and/or modified sequence opt3 from neuraminidase__InfluenzaA__AHM00506
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguaaaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 147117 - RNA, 1410 nt, Artificial Sequence; identical to SEQ ID NO: 144162
  derived and/or modified sequence opt3 from neuraminidase__InfluenzaA__AHM00518

SEQ ID NO: 147118 - RNA, 1410 nt, Artificial Sequence
  derived and/or modified sequence opt3 from neuraminidase__InfluenzaA__AHM00530
augaaccccaaucagaagaucauuaccauaggcagcgugucccugacaaucucuacuauuugcuucucaaugcagaucgccauucucaucacgaccgucacacuucacuuuaaacaguacgaguucaacccuccaccgaauaaccagguuaugcugugugaacccacuauaaucgagagaaauauuaccgaaaucguguauuugacaaacaccacuauugagaaggaaaucugcccuaaaccagcugaguacaggaauuggaguaagccccagugugggauaacaggauuugcaccuuucagcaaagacaacuccauucgguuaucugccgguggcgauaucuggguaacccgcgagccauaugugucgugcgaccccgauaaguguuaccaauuugcgcuggggcagggaacgacucuaaauaacguccauucaaauaacaccgugcgagaccguacaccuuauagaacucuccugaugaaugaacuuggcguuccauuccaccuggguaccaaacaggugugcauugcuuggagcaguuccucuugucaugaugggaaggccugguugcacgucugcaucacaggagacgauaagaacgcaaccgccagcuuuaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguucauugaggaagguaagaucgugcauacaucaacccucagcggcagugcccaacacgucgaggaaugcucuugcuauccgcgcuaccccgggguuagaugugugugcagggauaacuggaagggauccaaucggccuauaguagacauuaacaucaaagaucacagcaucgugucgucuuacgucuguuccggcuuagugggugacacgccacgcaagaaugacucaaguagcuccucucauugccuggaucccaacaaugaggaagggggacacggcguuaaaggcugggcuuuugacgaugggaacgacguguggaugggacgaaccauuaaugagacaagcagacuugguuaugagacuuucaaggucaucgaaggcuggucaaacccuaaaaguaaguugcagauuaauaggcaagugauaguagaucguggggaccgguccggauacagcggcaucuuuucuguugaggguaaaucauguauuaaccgcugcuucuauguggaacugaucagagggaggaaggaggaaaccgagguccuauggacaaguaauagcaucguggucuuuuguggcacuuccggaaccuacggcacagggucuuggccagauggagccgaccucaaccugaugcccauuuga

SEQ ID NO: 147119 - RNA, 1410 nt, Artificial Sequence; identical to SEQ ID NO: 145391
  derived and/or modified sequence opt3 from neuraminidase__InfluenzaA__AHM00542

SEQ ID NO: 147120 - RNA, 1410 nt, Artificial Sequence
  derived and/or modified sequence opt3 from neuraminidase__InfluenzaA__AHM00546
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgaaguacgucuguucuggauuagugggcgacacgccucgcaaaaaugauuccucaaguagcucccauugccuggacccaaacaaugaggaaggugggcacggaguuaagggcugggcuuucgaugacggcaacgauguguggauggggcgaaccauuaaugagacaucuagacuuggauaugagacuuuuaaagucaucgaagguuggagcaaccccaagucaaaauugcagauuaauaggcaagugauaguagaccggggcgaucguaguggguacuccggaaucuucagcguugagggcaagucuuguauuaaccgcugcuuuuauguggaacugaucagagguaggaaggaggaaaccgagguccuauggacaucaaauaguaucguggucuucugugggacuagcggcaccuacggaacaggcuccuggccugacggggccgaucucaaccugaugccaauuuga

SEQ ID NO: 147121 - RNA, 1410 nt, Artificial Sequence
  derived and/or modified sequence opt3 from neuraminidase__InfluenzaA__AHM00558
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 147122 - RNA, 1410 nt, Artificial Sequence; identical to SEQ ID NO: 144162
  derived and/or modified sequence opt3 from neuraminidase__InfluenzaA__AHM00570

SEQ ID NO: 147123 - RNA, 1410 nt, Artificial Sequence; identical to SEQ ID NO: 144162
  derived and/or modified sequence opt3 from neuraminidase__InfluenzaA__AHM00582

SEQ ID NO: 147124 - RNA, 1410 nt, Artificial Sequence
  derived and/or modified sequence opt3 from neuraminidase__InfluenzaA__AHM00594
augaaccccaaucagaagaucauuaccauaggcagcgugucccugacaaucucuacuauuugcuucuuuaugcagaucgccauucucaucacgaccgucacacuucacuucaaacagcaugaguuuaacucaccuccaaauaaccagguuaugcugugugaaccgacuauaaucgagagaaauauuaccgaaaucgugcacuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcagugcccaacaugucgaggaaugcucuugcuauccacgcuacccggggguuagaugugugugcagggauaacuggaagggauccaaucggcccauaguagacauuaacaucaaagaucacagcaucgugucgucuuaugucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuacgagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 147125 - RNA, 1410 nt, Artificial Sequence; identical to SEQ ID NO: 144162
  derived and/or modified sequence opt3 from neuraminidase__InfluenzaA__AHM00606

SEQ ID NO: 147126 - RNA, 1410 nt, Artificial Sequence; identical to SEQ ID NO: 144162
  derived and/or modified sequence opt3 from neuraminidase__InfluenzaA__AHM00618

SEQ ID NO: 147127 - RNA, 1410 nt, Artificial Sequence; identical to SEQ ID NO: 144162
  derived and/or modified sequence opt3 from neuraminidase__InfluenzaA__AHM00630

SEQ ID NO: 147128 - RNA, 1410 nt, Artificial Sequence; identical to SEQ ID NO: 144162
  derived and/or modified sequence opt3 from neuraminidase__InfluenzaA__AHM00642

SEQ ID NO: 147129 - RNA, 1410 nt, Artificial Sequence; identical to SEQ ID NO: 145391
  derived and/or modified sequence opt3 from neuraminidase__InfluenzaA__AHM00654

SEQ ID NO: 147130 - RNA, 1410 nt, Artificial Sequence; identical to SEQ ID NO: 144162
  derived and/or modified sequence opt3 from neuraminidase__InfluenzaA__AHM00666

SEQ ID NO: 147131 - RNA, 1410 nt, Artificial Sequence; identical to SEQ ID NO: 147070
  derived and/or modified sequence opt3 from neuraminidase__InfluenzaA__AHM00678

SEQ ID NO: 147132 - RNA, 1410 nt, Artificial Sequence; identical to SEQ ID NO: 145405
  derived and/or modified sequence opt3 from neuraminidase__InfluenzaA__AHM00690

SEQ ID NO: 147133 - RNA, 1410 nt, Artificial Sequence; identical to SEQ ID NO: 145391
  derived and/or modified sequence opt3 from neuraminidase__InfluenzaA__AHM00701

SEQ ID NO: 147134 - RNA, 1410 nt, Artificial Sequence
  derived and/or modified sequence opt3 from neuraminidase__InfluenzaA__AHM00713
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaagugcugaguacaggaauuggagcaagccucagugugggauaacaggauucgcaccauuuuccaaagacaacucuauucgguuaucggccgguggcgauaucuggguaacccgcgagcccuaugugucaugcgacccugauaaguguuaccaauucgcgcuggggcagggaacgacucuaaauaacguccauagcaauaacaccgugcgagaccguacaccauauagaacucuccugaugaaugaacuuggcguucccuuucaccuggguaccaaacaggugugcauugcuuggaguuccucuagcugucaugaugggaaggccugguugcacgucugcaucacaggagacgauaagaacgcaaccgccuccuucaucuacaauggcaggcucguggacucaguaguuaguuggagcaaagagauucugcggacgcaggaaucugagugugugugcauaaacggcacuuguacagucgugaugaccgauggguccgcuucaggaaaggcagacacuaaaauccuguuuauugaggaagguaagaucgugcauacaagcacccucaguggcucugcccaacacgucgaggaaugcuccugcuauccucgcuacccagggguuagaugugugugcagggauaacuggaagggaagcaaucggccgauaguagacauuaacaucaaagaucacucgaucgugucuuccuacgucuguucaggcuuagugggugacacgccccgcaagaaugacaguagcuccucuagccauugccuggauccuaacaaugaggaagggggacacggcguuaaaggcugggcuuucgacgaugggaacgacguguggaugggacgaaccauuaaugagacaucaagacuugguuaugagacuuuuaaggucaucgaaggcuggaguaacccaaaauccaaguugcagauuaauaggcaagugauaguagaucguggggaccggagcggauacucuggcaucuucucaguugaggguaaaaguuguauuaaccgcugcuuuuauguggaacugaucagagggaggaaggaggaaaccgagguccuauggacaagcaauuccaucguggucuucuguggcacuucuggaaccuacggcacagggucguggcccgauggagccgaccucaaccugaugccuauuuga

SEQ ID NO: 147135 - RNA, 1410 nt, Artificial Sequence; identical to SEQ ID NO: 144162
  derived and/or modified sequence opt3 from neuraminidase__InfluenzaA__AHM00725

SEQ ID NO: 147136 - RNA, 1410 nt, Artificial Sequence; identical to SEQ ID NO: 144162
  derived and/or modified sequence opt3 from neuraminidase__InfluenzaA__AHM00737

SEQ ID NO: 147137 - RNA, 1410 nt, Artificial Sequence; identical to SEQ ID NO: 147070
  derived and/or modified sequence opt3 from neuraminidase__InfluenzaA__AHM00749

SEQ ID NO: 147138 - RNA, 1410 nt, Artificial Sequence; identical to SEQ ID NO: 144162
  derived and/or modified sequence opt3 from neuraminidase__InfluenzaA__AHM00761

SEQ ID NO: 147139 - RNA, 1410 nt, Artificial Sequence; identical to SEQ ID NO: 145391
  derived and/or modified sequence opt3 from neuraminidase__InfluenzaA__AHM00785

SEQ ID NO: 147140 - RNA, 1410 nt, Artificial Sequence; identical to SEQ ID NO: 145026
  derived and/or modified sequence opt3 from neuraminidase__InfluenzaA__AHM00797

SEQ ID NO: 147141 - RNA, 1410 nt, Artificial Sequence
  derived and/or modified sequence opt3 from neuraminidase__InfluenzaA__AHM00809
augaaccccaaucagaagaucauuaccauaggcagcgugucccugacaaucucuacuauuugcuucuuuauccaaauugccauccucauaacgaccgucacacuucacuucaaacaguacgaguuuaacucaccuccaaauaaccagguuaugcugugugaaccgacuaucauugagagaaauaucaccgaaauuguguauuugacaaacaccacuaucgagaaggaaauaugccccaaaccugcugaguacaggaauuggaguaagccacagugugacauuacaggguucgcacccuuuagcaaagauaacuccauccgguuaucugccggaggugacauuuggguaacccgcgagccuuaugugucgugcgauccagacaaguguuaccaauucgcgcugggccaggggacgacucuaaauaacaugcauucaaauaacaccguccgagaucguacacccuauagaacucuccugaugaaugaacuuggagugccuuuucaccugggcaccaagcagguuugcaucgcuuggagcaguuccucuugucaugacgguaaagccugguugcacgugugcaucacaggggaugacaagaacgcaaccgccagcuucauuuacaauggaaggcucgucgauuccgugguaucauggaguaaagagauacugcggacgcaggaaagcgaguguguuugcaucaacggcacuuguacaguggucaugaccgacggcucugcuuccgggaaggcagauacuaaaauucuguuuaucgaggaaggaaagauagugcauacaucaacccucagcgguagugcccaacacguggaggaaugcucuugcuauccacgcuacccgggcgucagauguguuugcagggacaacuggaagggguccaaucggcccauuguggauaucaacaucaaagaccacagcauuguaucgucuuacguguguuccggauuagucggcgacacgccucgcaagaaugauucaaguagcuccucucauugccuggacccaaacaaugaggaaggugggcacggagugaaaggcugggcuuucgaugacggcaacgauguuuggauggggcgaaccaucaaugagacaagcagacuuggauaugagacuuuuaaggugauugaagguuggucaaaccccaaaaguaaguugcagauaaauaggcaggucaucguggaccggggcgaucguuccggguacagcggaauuuucucuguagagggcaaaucauguaucaaccgcugcuuuuauguugaacugaucagagguaggaaggaggaaaccgaggugcuauggacaaguaauagcauugucguguucugugggacuuccggcaccuacggaacaggcucuuggccugacggggccgaucucaaccugaugccaauauga

SEQ ID NO: 147142 - RNA, 1410 nt, Artificial Sequence; identical to SEQ ID NO: 147070
  derived and/or modified sequence opt3 from neuraminidase__InfluenzaA__AHM00821

SEQ ID NO: 147143 - RNA, 1410 nt, Artificial Sequence; identical to SEQ ID NO: 147070
  derived and/or modified sequence opt3 from neuraminidase__InfluenzaA__AHM00833

SEQ ID NO: 147144 - RNA, 1410 nt, Artificial Sequence; identical to SEQ ID NO: 145026
  derived and/or modified sequence opt3 from neuraminidase__InfluenzaA__AHM00845

SEQ ID NO: 147145 - RNA, 1410 nt, Artificial Sequence; identical to SEQ ID NO: 144162
  derived and/or modified sequence opt3 from neuraminidase__InfluenzaA__AHM00857

SEQ ID NO: 147146 - RNA, 1410 nt, Artificial Sequence; identical to SEQ ID NO: 144162
  derived and/or modified sequence opt3 from neuraminidase__InfluenzaA__AHM00869

SEQ ID NO: 147147 - RNA, 1410 nt, Artificial Sequence; identical to SEQ ID NO: 144162
  derived and/or modified sequence opt3 from neuraminidase__InfluenzaA__AHM00881

SEQ ID NO: 147148 - RNA, 1410 nt, Artificial Sequence; identical to SEQ ID NO: 145391
  derived and/or modified sequence opt3 from neuraminidase__InfluenzaA__AHM00893

SEQ ID NO: 147149 - RNA, 1410 nt, Artificial Sequence
  derived and/or modified sequence opt3 from neuraminidase__InfluenzaA__AHM00905
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaccgacucaaguagcuccgggcauugccuggauccaaauaacgaggaaggaggccacggcguuaaagggugggcuuucgacgauggaaaugacguguggaugggucgaacaauuaacgagacuucuagacuuggcuaugagaccuuuaaggucaucgaaggguggagcaaucccaaaucaaaguugcagauuaacaggcaagugauaguagaucggggagaccguaguggcuacuccgguaucuucagcguugaggggaaaucuuguauuaaucgcugcuuuuauguggaacugaucagaggcaggaaggaggaaacagagguccuauggacuucaaacaguaucguggucuucuguggaaccagcggcacauacgggaccggauccuggccugauggugccgaccucaaucugaugccaauuuga

SEQ ID NO: 147150 - RNA, 1410 nt, Artificial Sequence
  derived and/or modified sequence opt3 from neuraminidase__InfluenzaA__AHM00917
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacauuuggaugggacgaaccaucaaugagacaagcagacuugguuaugagacuuuuaaggugauugaaggcuggucaaaccccaaaaguaaguugcagauaaauaggcaggucaucguggaucguggggaccgguccggauacagcggcauuuucucuguagaggguaaaucauguaucaaccgcugcuuuuauguugaacugaucagagggaggaaggaggaaaccgaggugcuauggacaaguaauagcauugucguguucuguggcacuuccggaaccuacggcacagggucuuggccugauggagccgaccucaaccugaugccaauauga

SEQ ID NO: 147151 - RNA, 1410 nt, Artificial Sequence; identical to SEQ ID NO: 144162
  derived and/or modified sequence opt3 from neuraminidase__InfluenzaA__AHM00929

SEQ ID NO: 147152 - RNA, 1410 nt, Artificial Sequence
  derived and/or modified sequence opt3 from neuraminidase__InfluenzaA__AHM00941
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccauucgagaucguacacccuauagaacucuccugaugaaugaacuuggagugccuuuucaccugggcaccaagcagguuugcaucgcuuggagcaguuccucuugucaugacgguaaagccugguugcacgugugcaucacaggggaugacaagaacgcaaccgccagcuucauuuacaauggaaggcucgucgauuccgugguaucauggaguaaagagauacugcggacgcaggaaagcgaguguguuugcaucaacggcacuuguacaguggucaugaccgacggcucugcuuccgggaaggcagauacuaaaauucuguuuaucgaggaaggaaagauagugcauacaucaacccucagcgguagugcccaacacguggaggaaugcucuugcuauccacgcuacccgggcgucagauguguuugcagggacaacuggaagggguccaaucggcccauuguggauaucaacaucaaagaccacagcauuguaucgcgcuacguguguucuggauuagucggcgacacgccucgaaagaaugauuccucaaguagcucccauugccuggacccaaacaaugaggaaggugggcacggagugaaaggcugggcuuucgaugacggcaacgauguuuggauggggagaaccaucaaugagacaucuaggcuuggauaugagacuuuuaaggugauugaagguuggagcaaccccaaaucaaaguugcagauaaaucggcaggucaucguggaccguggcgaucgcaguggguacuccggaauuuucagcguagagggcaaaucuuguaucaacagaugcuuuuauguugaacugaucaggggucggaaggaggaaaccgaggugcuauggacaucaaauaguauugucguguucugugggacuagcggcaccuacggaacaggcuccuggccugacggggccgaucucaaccugaugccaauauga

SEQ ID NO: 147153 - RNA, 1410 nt, Artificial Sequence
  derived and/or modified sequence opt3 from neuraminidase__InfluenzaA__AHM00953
augaaccccaaucagaagaucauuaccauaggcagcgugucccugacaaucucuacuauuugcuucuuuaugcagaucgccauucucaucacgaccgucacacuucacuucaaacaguacgcuuuuaacucaccuccaaauaaccagguuaugcugugugagccgacuauaaucgaaagaaauauuaccgagaucguguauuugacaaacaccacuauugaaaaggagaucugccccaaaccugcagaauacaggaauuggaguaagccacagugugggauaacaggauucgcccccuuuagcaaagacaacuccauucgguuaucugcggguggcgauaucuggguaacccgcgagccuuaugugucgugcgacccagauaaguguuaccaauucgcucuggggcagggaacgacucuaaauaacguccauucaaauaacaccgugcgagaccguacacccuauagaacucuccugaugaaugagcuuggcguuccuuuucaccuggguaccaaacaggugugcauugccuggagcaguuccucuugucaugaugggaaggcaugguugcacgucugcaucacaggagacgauaagaacgccaccgcuagcuucaucuacaauggcaggcucguggacuccguaguuucauggaguaaagaaauucugcggacgcaggagagcgaaugugugugcauaaacggcacuuguacagucgugaugaccgaugggucugcauccggaaaggccgacacuaaaauccuguuuauugaggaggguaagaucgugcauacaucaacccucagcggcagugcucaacacgucgaagagugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaagaagggggacacggcguuaaaggcugggccuucgacgaugggaacgacguguggaugggacgaaccauuaaugagacaagcagacuugguuaugagacuuuuaaggucaucgagggcuggucaaaccccaaaaguaaguugcagauuaauaggcaagugauaguagaucguggggaccgguccggauacagcggcaucuucucuguugaagguaaaucauguauuaaccgcugcuuuuauguggagcugaucagagggaggaaggaagagaccgaaguccuauggacaaguaauagcaucguggucuucuguggcacuuccggaaccuacggcacagggucuuggccugauggagcggaccucaaccugaugccaauuuga

SEQ ID NO: 147154 - RNA, 1410 nt, Artificial Sequence; identical to SEQ ID NO: 145391
  derived and/or modified sequence opt3 from neuraminidase__InfluenzaA__AHM00965

SEQ ID NO: 147155 - RNA, 1410 nt, Artificial Sequence; identical to SEQ ID NO: 145391
  derived and/or modified sequence opt3 from neuraminidase__InfluenzaA__AHM00977

SEQ ID NO: 147156 - RNA, 1398 nt, Artificial Sequence
  derived and/or modified sequence opt3 from neuraminidase__InfluenzaA__AHM24226
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagagacuacgaauaccucacagacaauaaucaacaauuacuauaacgaaacuaauauuaccaacauccagauggaggaaagaacaaguaggaauuucaacaaucugaccaaggggcuauguacuauuaacagcuggcacaucuacggaaaagacaaugcuguccggauaggcgaguccucugauguucucgugacacgcgaaccguauguaucgugcgaccccgaugagugucgauuuuacgcccugucacaggguaccacgauucgugggaagcauagcaacggaacuauccacgacagaagucaauauagggcacuuauuuccuggccucugucuagcccacccaccguguacaacucccgggucgagugcaucggcuggucaaguacaagcugucaugauggcaaaucucgcauguccaucugcauuucagggccuaauaacaaugccagcgcugugguuugguauaacagaaggccaguggcagaaauaaauacuugggcccggaacaucuugcgcacccaggagagugaaugugucugccacaauggagugugucccguaguuuucacagacgguucugcuaccggcccugccgauacgcgaauuuacuacuuuaaggaggggaagaugcucaaaugggagucccugacuggaacagcgaagcacaacgaagagugcagcugcuauggcgaaagaaccgguaucacuuguacaugcagggacaauuggcaggggucgaaccggccagugauacagauugauccggucgcaaugacccauacgucucaauacaucuguucccccgugcugaccgacaauccucguccaaacgaucccaauaucggaaaaugcaacgacccuuauccaggcaauaacaacaauggcgugaagggguucucauaccucgauggagccaacacaugguuaggucgcacuauuaguaccgcuagcagauccggcuaugagaugcugaaaguccccaaugcccuuacagacgacaggucuaagccgauccaggggcagacuauuguuuugaacgcagauuggagcggauacucaggcaguuuuauggacuauugggcugaaggugauuguuaccgggccugcuucuacguggagcugauacgagggcgcccuaaggaggacaaaguaugguggaccuccaauagcaucgugucuauguguucaaguacagaauuucuaggccaguggaacuggcccgauggagcgaagauugaguauuuccucuga

SEQ ID NO: 147157 - RNA, 1398 nt, Artificial Sequence; identical to SEQ ID NO: 145470
  derived and/or modified sequence opt3 from neuraminidase__InfluenzaA__AHM24238

SEQ ID NO: 147158 - RNA, 1398 nt, Artificial Sequence
  derived and/or modified sequence opt3 from neuraminidase__InfluenzaA__AHM24250
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuaccaacauccagauggaggaaagaacaagcaggaauuucaacaaucugaccaagggccuauguacuauuaacuccuggcacaucuacgggaaagacaaugcuguccggauaggagagaacucugauguucucgugacacgcgaaccguauguaucgugcgaccccgaugagugucgauuuuacgcccugucacagggcaccacgauucgugguaagcauagcaacgggacuauccacgacagaagucaauauagggcacuuauuuccuggccucugucuagcccacccaccguguacaauucccgggucgagugcaucggauggucaaguacaagcugucaugauggcaaaucucgcauguccaucugcauuucaggcccuaacaauaacgccagcgcugugguuugguauaauagaaggccaguggcagaaauaaacacuugggcccggaauaucuugcgcacccaggagagugaaugugucugccacaacggggugugucccguaguuuucacagacggaucugcuaccgguccugccgauacgcgaauuuacuacuuuaaggagggcaagauccucaaaugggagucccugacugggacagcgaagcacauagaagagugcagcugcuauggagaaagaaccggcauuacuuguacaugcagggacaauuggcaggguucgaaccggccagugauccagaucgauccggucgcaaugacccauacgucucaauacauuuguucccccgugcugaccgacaauccucguccaaacgaucccaauaucgggaaaugcaacgacccuuauccaggaaauaacaacaauggcgugaagggcuucucauaccucgauggggccaacacaugguuaggacgcacuauuaguaccgcuagcagauccgguuaugagaugcugaaaguccccaaugcccuuacagacgacaggucuaagccgauacagggccagacuaucguuuugaacgcagauuggagcggguacucaggaaguuuuauggacuauugggcugaaggcgauuguuaccgggccugcuucuacguggagcugauucgaggucgcccuaaggaggacaaaguaugguggaccuccaauagcaucgugucuauguguucaaguacagaauuucuagggcaguggaacuggcccgauggcgcgaagaucgaguauuuccucuga

SEQ ID NO: 147159 - RNA, 1410 nt, Artificial Sequence; identical to SEQ ID NO: 142725
  derived and/or modified sequence opt3 from neuraminidase__InfluenzaA__AHM98312

SEQ ID NO: 147160 - RNA, 1410 nt, Artificial Sequence
  derived and/or modified sequence opt3 from neuraminidase__InfluenzaA__AHM98331
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguucacuccgacacugugggcuggucauggcccgauggugcagaguuaccguucacaauugacaaauga

SEQ ID NO: 147161 - RNA, 1410 nt, Artificial Sequence; identical to SEQ ID NO: 142741
  derived and/or modified sequence opt3 from neuraminidase__InfluenzaA__AHM98342

SEQ ID NO: 147162 - RNA, 1410 nt, Artificial Sequence
  derived and/or modified sequence opt3 from neuraminidase__InfluenzaA__AHM98353
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcguggaugggucuuguuucaccaucaugacagacggaccauccgauggccaggcuucauacaaaauuuuucggaucgaaaaggguaaaauugucaagaguguggagaugaaugcccccaacuaucauuacgaagagugcagcuguuacccugacuccucugagauaacuugcgugugccgcgauaauuggcacgggagcaacagaccaugggucucauucaaucagaaccucgaauaucagaucggauacauuuguaguggcaucuuuggcgacaauccgaggcccaacgauaaaaccggguccugcggaccuguuagcucuaauggugcgaacggcgugaagggguucucauuuaaguauggaaauggcguauggaucggucggacaaaaaguauuagcucccgcaagggguucgagaugauaugggacccaaacggcuggaccggaacggacaacaauuuuucuaucaaacaagauauugugggcaucaacgaauggucgggguacagcggauccuucguccagcaucccgagcugacuggucuggacuguauucgaccuugcuucuggguggaacucaucagaggcaggccaaaggagaauacaauauggaccucagggaguucuaucagcuuuuguggaguuaacuccgauacugugggcuggucauggcccgacggugcagaguuaccguucacaauugauaaauga

SEQ ID NO: 147163 - RNA, 1410 nt, Artificial Sequence
  derived and/or modified sequence opt3 from neuraminidase__InfluenzaA__AHM98364
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaccuggccgggaauagcucauugugcccugugaguggaugggcgauauacuccaaagacaacucuauuagaaucggcagcaagggugauguuuuugugauuagggagccauucaucuccuguucaccguuagaaugccggaccuuuuuccugacacagggggcucuacucaaugacaaacauaguaacggaaccaucaaggaucgcagccccuaucgaacucugaugucuuguccuauuggcgaggucccaucccccuacaacucacguuuugaaagcguggccuggagugcaucugccugccacgacggcauaaauuggcuuacaaucgggauuuccggaccugauaacggugcuguagcaguucugaaauauaauggcaucauaaccgacacgauuaagagcuggagaaacaauaucuugaggacucaagagucggagugugccugcgugaacgggucuuguuucaccaucaugacagauggaccauccgacggccaggcuucauacaagauuuuucggaucgaaaaagguaagauugucaaaaguguggagaugaaugcccccaacuaucauuacgaagagugcagcuguuacccugauuccucugagauaacuugcgugugccgcgacaauuggcacgggagcaacagaccaugggucucauucaaucagaaccucgaauaucagaucggauacauuuguaguggcaucuuuggcgauaauccgaggcccaacgacaagaccggguccugcggaccuguuagcucuaauggugcgaacggcgugaaaggguucucauuuaaguauggaaacggcguauggaucggucggacaaagaguauuagcucccgcaaaggguucgagaugauaugggauccaaauggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccaaaagagaauacaauauggaccucagggaguucuaucagcuuuuguggaguuaacuccgacacugugggcuggucauggcccgauggugcagaguuaccguucacaauugacaaguga

SEQ ID NO: 147164 - RNA, 1410 nt, Artificial Sequence
  derived and/or modified sequence opt3 from neuraminidase__InfluenzaA__AHM98375
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuuucgaacucugaugagcuguccuauuggcgaggucccaucucccuauaacucccguuucgaaucaguggccuggagcgcaagugccugccacgacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuuuaccaucaugacagauggaccaucugacggccaggcuuccuauaaaauuuuccggaucgaaaaggguaaaauugucaagucaguggagaugaaugcccccaacuaccauuaugaagagugcaguuguuacccugauagcuccgagauaacuugcgugugccgcgacaauuggcacgggucuaacagaccaugggucagcuuuaaucagaaccucgaauaccagaucggauauauuuguucaggcaucuucggcgauaauccgaggcccaacgacaaaaccgggaguugcggaccuguuuccagcaauggugcgaacggcgugaagggguuuucuuucaaguacggaaacggcguauggaucggucggacaaaaucaauuaguagccgcaagggguuugagaugauaugggauccaaauggcuggaccggaacggacaacaauuucuccaucaaacaagacauugugggcaucaacgaauggucuggguauucggggagcuucguccagcaucccgagcugacuggucuggauuguauucgaccuugcuuuuggguggaacucaucagaggcaggccaaaggagaauacaauauggaccuccgggucaaguaucucuuucuguggaguuaacagcgacacugugggcugguccuggcccgauggugcagaguuaccguuuacaauugacaaauga

SEQ ID NO: 147165 - RNA, 1410 nt, Artificial Sequence; identical to SEQ ID NO: 142725
  derived and/or modified sequence opt3 from neuraminidase__InfluenzaA__AHM98386

SEQ ID NO: 147166 - RNA, 1410 nt, Artificial Sequence
  derived and/or modified sequence opt3 from neuraminidase__InfluenzaA__AHM98408
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcaggccagucugugguaucggugaaacuggccgggaacagcucauugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcauaauuaccgacacgaucaagagcuggagaaauaacaucuugaggacucaagagucggagugugccugcguuaaugggucuuguuucaccauuaugacagauggaccauccgacggccaggcuucauacaaaaucuuucggauugaaaaggguaaaauagugaagagugucgagaugaacgcccccaauuaucauuacgaagagugcagcuguuacccugauuccucugagaucacuugcgugugccgcgacaacuggcacgggagcaauagaccaugggugucauucaaccagaaucucgaauaucagauuggauacaucuguaguggcaucuuuggcgauaacccgaggcccaaugacaaaaccggguccugcggaccugucagcucuaacggugcgaauggcguuaagggguucucauuuaaguauggaaacggcguguggauuggucggacaaaaaguauaagcucccgcaagggguucgagaugaucugggauccaaacggcuggaccggaacggacaauucuuuuucgauuaaacaagacaucguaggcauuaacgaauggagcggguacuccggaucauucgugcagcaucccgagcugacuggucuggauuguauccgaccuugcuucugggucgaacucauaagaggcaggccaaaggagaauacaaucuggaccagugggucuagcauuuccuuuuguggagugaacucagacacuguuggcuggagcuggcccgauggugcagaguuaccguucacaaucgacaaauga

SEQ ID NO: 147167 - RNA, 1410 nt, Artificial Sequence; identical to SEQ ID NO: 147166
  derived and/or modified sequence opt3 from neuraminidase__InfluenzaA__AHM98419

SEQ ID NO: 147168 - RNA, 1410 nt, Artificial Sequence
  derived and/or modified sequence opt3 from neuraminidase__InfluenzaA__AHM98430
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaaacgucauuacguacgaaaauaacaccuggguuaaucagacauaugugaacaucagcaauacuaacuucgcugcaggccaguccguagugccugucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccaucaugacagauggacccucggacggccaggcuucuuacaaaauuuuucggaucgaaaaggguaaaauugucaaguccguggagaugaaugccccuaacuaucauuacgaagagugcucauguuacccagauaguagcgagauaacuugcgugugccgcgacaauuggcacggguccaacagaccgugggucucuuucaaucagaaccucgaauaucagaucggauacauuuguagcggcaucuuuggcgauaaucccaggccuaacgacaaaaccgggucaugcggaccaguuaguuccaauggugcgaacggcgugaagggguucagcuuuaaguauggaaacggcguauggaucggucggacaaaaucuauuucaagucgcaagggguucgagaugauaugggaucccaauggcuggaccggaacggacaacaauuuuagcaucaaacaagacauugugggcaucaacgaaugguccggguacucuggaucguucguccagcauccugagcugacuggucuggauuguauucgaccaugcuucuggguggaacucaucagaggcaggcccaaggagaauacaauauggaccagcggguccucaaucaguuuuuguggaguuaacucugacacugugggcuggagcuggccggauggugcagaguuaccuuucacaauugacaaauga

SEQ ID NO: 147169 - RNA, 1410 nt, Artificial Sequence; identical to SEQ ID NO: 142973
  derived and/or modified sequence opt3 from neuraminidase__InfluenzaA__AHM98441

SEQ ID NO: 147170 - RNA, 1410 nt, Artificial Sequence
  derived and/or modified sequence opt3 from neuraminidase__InfluenzaA__AHM98452
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcagcuugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaacuugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguaugggaacggaguauggaucggccgcacaaaaaguauuagcucccgaaaggguuucgagaugauaugggauccaaacggguggaccggcacggacaauaacuuuucuaucaaacaagacauugugggagucaaugaauggucgggcuacagcggguccuucgugcagcaucccgagcugacuggacuggauuguaucagaccuugcuucuggguugaacucauuaggggucggccaaaggagaacacaaucuggaccucaggcaguucuauaucauuuuguggggucaauuccgacacugugggauggucauggcccgauggcgcagaguuaccguucacaaucgacaaauga

SEQ ID NO: 147171 - RNA, 1410 nt, Artificial Sequence; identical to SEQ ID NO: 142725
  derived and/or modified sequence opt3 from neuraminidase__InfluenzaA__AHM98474

SEQ ID NO: 147172 - RNA, 1410 nt, Artificial Sequence
  derived and/or modified sequence opt3 from neuraminidase__InfluenzaA__AHM98485
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacugguggggaacucauccuugugcccuguuaguggaugggccauauacuccaaggacaauucuauuagaaucggcagcaaaggugauguguuugucauuagggagccauucaucuccuguucaccguuagaaugccggaccuuuuuccugacacagggggcgcuacucaacgacaagcauaguaauggaaccaucaaagaucgcagccccuaucgaacucugaugucuuguccuauuggcgaggugccaucccccuacaacucacguuuugaaagcguagcuuggagugccucugcaugccacgacggcauaaacuggcuuacaaucgggauuuccggaccugauaauggugccguugcugugcugaaguauaacggcaucauaaccgacacgauuaagagcuggagaaauaacaucuugaggacucaagagucggagugugcaugcgucaaugggucuuguuucaccaucaugacagauggaccauccgacggccaggccucauacaaaauuuuucggaucgaaaaggguaaaauugugaagaguguggagaugaacgcucccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugccaauggcguaaagggguucucauuuaaguauggaaacggcguguggaucggucggacaaaaaguauuagcucccgcaagggguucgagaugauaugggauccaaacggcuggaccggaacggacaauaacuuuucuaucaaacaagacauugucggcaucaaugaauggucgggguacagcggauccuucgugcagcaucccgagcugacuggucuggauuguauucgaccuugcuucuggguugaacucaucagaggcaggccaaaggagaacacaauauggaccucagggaguucuaucagcuuuuguggagugaauagcgacacugucggcuggucauggcccgauggugcggaguuaccguucacaauugacaaauga

SEQ ID NO: 147173 - RNA, 1410 nt, Artificial Sequence
  derived and/or modified sequence opt3 from neuraminidase__InfluenzaA__AHM98496
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaaaaccgcagucccuaucgaacucugaugagcuguccuauuggcgaggucccaucucccuacaauucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccaucaugacagacggaccaucugauggccaggcuuccuacaaaauuuuucggaucgaaaaggguaaaauugucaagucaguggagaugaacgcccccaauuaucauuacgaagagugcaguuguuacccugacagcuccgagauaaaaugcgugugccgcgauaacuggcacgggucuaauagaccaugggucagcuucaaccagaaucucgaauaucagaucggauacauuuguucaggcaucuuuggcgacaacccgaggcccaaugauaagacugggaguugcggaccuguuuccagcaacggugcgaacggcgugaagggguucucuuuuaaauauggaaauggcguauggaucggucggaccaagucaauuaguagccgcaaaggguucgagaugauaugggacccaaacggcuggacaggaaccgauaauaacuuuuccaucaagcaagacauugugggcaucaaugaauggucuggguacucggggagcuucguccagcaucccgagcugacgggucuggacuguauucgaccuugcuucuggguggaacucaucagaggcaggccaaaagagaacacuauauggacauccgggucaaguaucucuuuuuguggaguuaauagcgauaccgugggcugguccuggcccgacggugcagaguuaccguucacuauugauaaguga

SEQ ID NO: 147174 - RNA, 1410 nt, Artificial Sequence; identical to SEQ ID NO: 142725
  derived and/or modified sequence opt3 from neuraminidase__InfluenzaA__AHM98507

SEQ ID NO: 147175 - RNA, 1410 nt, Artificial Sequence
  derived and/or modified sequence opt3 from neuraminidase__InfluenzaA__AHM98518
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcaggccagucugugguaucggugaaacuggccgggaacucauccuugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcauaauuaccgacacgaucaagagcuggagaaauaacaucuugaggacucaagagucggagugugccugcguuaaugggucuuguuucaccauuaugacagauggaccauccgacggccaggcuucauacaaaaucuuucggauugaaaaggguaaaauagugaagagugucgagaugaacgcccccaauuaucauuacgaagagugcagcuguuacccugauuccucugagaucacuugcgugugccgcgacaacuggcacgggagcaauagaccaugggugucauucaaccagaaucucgaauaucagauuggauacaucuguaguggcaucuuuggcgauaacccgaggcccaaugacaaaaccggguccugcggaccugucagcucuaacggugcgaauggcguuaagggguucucauuuaaguauggaaacggcguguggauuggucggacaaaaaguauaagcucccgcaagggguucgagaugaucugggauccaaacggcuggaccggaacggacaauaacuuuucuauuaaacaagacaucguaggcauuaaugaauggucgggguacagcggauccuucgugcagcaucccgagcugacuggucuggauuguauccgaccuugcuucugggucgaacucauaagaggcaggccaaaggagaacacaaucuggaccucagggaguucuaugagcuuuuguggagugaauagcgacacuguuggcuggucauggcccgauggugcagaguuaccguucacaauugacaaauga

SEQ ID NO: 147176 - RNA, 1410 nt, Artificial Sequence; identical to SEQ ID NO: 142273
  derived and/or modified sequence opt3 from neuraminidase__InfluenzaA__AHM98529

SEQ ID NO: 147177 - RNA, 1410 nt, Artificial Sequence; identical to SEQ ID NO: 143017
  derived and/or modified sequence opt3 from neuraminidase__InfluenzaA__AHM98540

SEQ ID NO: 147178 - RNA, 1410 nt, Artificial Sequence
  derived and/or modified sequence opt3 from neuraminidase__InfluenzaA__AHM98562
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaagcggggaguugcggaccuguuuccagcaauggugcaaacggcgugaagggguucucuuuuaaguauggaaacggcguauggaucggucggaccaaaucaauuaguagccgcaagggguucgagaugauaugggauccaaauggcuggacaggaaccgacaacaauuuuuccaucaaacaagacauugugggcaucaacgaauggucuggguacucggggagcuucguccagcaucccgagcugacgggucuggauuguauucgaccuugcuucuggguggaacucaucagaggcaggccaaaggagaauacuauauggacauccgggucaaguaucucuuuuuguggaguuaacagcuauaccgugggcugguccuggcccgacggugccgaguuaccguucacuauugauaaauga

SEQ ID NO: 147179 - RNA, 1410 nt, Artificial Sequence; identical to SEQ ID NO: 147168
  derived and/or modified sequence opt3 from neuraminidase__InfluenzaA__AHM98573

SEQ ID NO: 147180 - RNA, 1410 nt, Artificial Sequence
  derived and/or modified sequence opt3 from neuraminidase__InfluenzaA__AHM98584
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcaggccagucugugguaucggugaaacuggccgggaacagcucauugugcccugucaguggaugggcgauuuacuccaaggacaauucuaucagaauuggcagcaaaggugauguguuuguuaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugagauauaacggcauaauuaccgacacgaucaagagcuggaggaauaacaucuugcggacucaagagucggagugugccugcguuaaugggucuuguuucaccauuaugacagauggaccauccgacggccaggcuucauacaagaucuuucgcauugaaaaagguaagauagugaaaagugucgagaugaacgcccccaauuaucauuacgaagagugcagcuguuacccugauuccucugagaucacuugcgugugcagagacaacuggcacgggagcaauaggccaugggugucauucaaccagaaucucgaauaucagauuggauacaucuguaguggcaucuuuggcgauaacccgcggcccaaugacaagaccggguccugcggaccugucagcucuaacggugcgaauggcguuaaaggguucucauuuaaguauggaaacggcguguggauuggucgcacaaagaguauaagcucccgaaaaggguucgagaugaucugggauccaaacggcuggaccggaacggacaauucuuuuucgauuaagcaagacaucguaggcauuaacgaauggagcggguacuccggaucauucgugcagcaucccgagcugacuggucuggauuguaucagaccuugcuucugggucgaacucauaaggggccggccaaaagagaauacaaucuggaccagugggucuagcauuuccuuuuguggagugaacucagacacuguuggcuggagcuggcccgauggugcagaguuaccguucacaaucgacaaguga

SEQ ID NO: 147181 - RNA, 1410 nt, Artificial Sequence; identical to SEQ ID NO: 147168
  derived and/or modified sequence opt3 from neuraminidase__InfluenzaA__AHM98595

SEQ ID NO: 147182 - RNA, 1410 nt, Artificial Sequence; identical to SEQ ID NO: 142725
  derived and/or modified sequence opt3 from neuraminidase__InfluenzaA__AHM98606

SEQ ID NO: 147183 - RNA, 1410 nt, Artificial Sequence
  derived and/or modified sequence opt3 from neuraminidase__InfluenzaA__AHM98617
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggaucaaccagacauauguuaauauauccaacacuaauuucgcugcaggccagucugugguaucggugaaacuggccgggaacagcucauugugcccugucaguggaugggcgauuuacuccaaggacaauucuaucagaauuggcagcaaaggugauguguuuguuaucagggagccauucaucuccuguucaccguuagggugccggaccuuuuuccugacacagggagcucuacucaacgacaagcauaguaauggcaccauuaaagaucgcagccccuaucgaacucugaugucuuguccuauaggcgaagugccaucccccuacaacucacguuuugagagcgucgccuggagugcaucugccugccacgacgggaucaacuggcuuacaauuggaaucuccgguccugauaauggcgcuguggcaguacugaaguauaacgggauaauuaccgacacgaucaagagcuggagaaauaacaucuugaggacucaagaaucggagugugccugcguuaauggaucuuguuucaccauuaugacagauggcccauccgacggucaggcuucauacaaaaucuuucggauugagaaggggaaaauagugaagagugucgaaaugaacgcccccaauuaucauuacgaggaaugcagcuguuacccugauuccucugagaucacuugcgugugccgcgacaacuggcacggaagcaauagaccaugggugucauucaaccagaaucucgaguaucagauuggcuacaucuguaguggcaucuuuggggauaacccgaggcccaaugacaaaaccggauccugcgguccugucagcucuaacggcgcgaaugggguuaagggauucucauuuaaguauggcaacgguguguggauugggcggacaaaaaguauaagcucccgcaagggcuucgaaaugaucugggauccaaacggauggaccggcacggacaauucuuuuucgauuaaacaagacaucguagggauuaacgaguggagcggauacuccgguucauucgugcagcaucccgaacugacuggccuggauuguauccgaccuugcuucugggucgagcucauaagagggaggccaaaggaaaauacaaucuggaccaguggaucuagcauuuccuuuuguggcgugaacucagacacuguugguuggagcuggcccgauggggcagaguuaccguucacaaucgacaaauga

SEQ ID NO: 147184 - RNA, 1410 nt, Artificial Sequence; identical to SEQ ID NO: 147166
  derived and/or modified sequence opt3 from neuraminidase__InfluenzaA__AHM98628

SEQ ID NO: 147185 - RNA, 1410 nt, Artificial Sequence
  derived and/or modified sequence opt3 from neuraminidase__InfluenzaA__AHM98639
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuaucuacgaaaacaauacguggauaaaccagaccuauguuaauauuuccaacacaaauuucgcugcagagcagucugugguaucggugaaacuggccggcaacagcucauugugcccugucagugggugggcgaucuacuccaaggacaauucuauuagaaucggaagcaaaggcgauguguuuguuaucagggaaccauucauuuccuguucaccguuagagugccggaccuuuuuccugacucagggugcucuacucaacgacaagcauaguaaugggacaauaaaagaucgcagccccuaucgaacccugaugucuuguccuaucggagaagugccaucccccuacaacucacguuuugagagcgucgccuggagugcaucugccugccacgacggcauuaacuggcuuacuaucggcauauccgggccugauaauggagcuguggcaguacugaaguauaacgguauuaucacagacaccaucaagagcuggagaaauaacauuuugaggacgcaagagucggaaugugccugcguuaauggcucuuguuucacuaucaugaccgaugggccauccgacggacaggcuucauacaaaauuuuucggauagagaagggcaaaaucgugaagagugucgaaaugaacgcccccaauuaucauuacgaggagugcagcuguuacccugauuccucugaaauuacaugcgugugccgcgacaacuggcacgguagcaauagaccaugggugucauucaaccagaaucucgaguaucagaucggguacaucuguaguggaauuuuuggcgauaacccgaggcccaaugacaaaacuggcuccugcgggccugucagcucuaacggagcgaaugguguuaagggcuucucauuuaaguaugggaacggaguguggauaggccggaccaaaaguaucagcucccgcaaggguuucgaaaugauuugggauccaaacggguggacaggcaccgacaauucuuuuucgaucaaacaagacauuguaggaaucaacgaguggagcggcuacuccgggucauucgugcagcaucccgaacugacgggacuggauuguauacgaccuugcuucugggucgagcucaucagagguaggccaaaggagaauacuauuuggacaaguggcucuagcaucuccuuuuguggggugaacucagacaccguuggauggagcuggcccgauggcgcagaauuaccguucacuauugacaaauga

SEQ ID NO: 147186 - RNA, 1410 nt, Artificial Sequence; identical to SEQ ID NO: 142725
  derived and/or modified sequence opt3 from neuraminidase__InfluenzaA__AHM98650

SEQ ID NO: 147187 - RNA, 1410 nt, Artificial Sequence; identical to SEQ ID NO: 142725
  derived and/or modified sequence opt3 from neuraminidase__InfluenzaA__AHM98661

SEQ ID NO: 147188 - RNA, 1410 nt, Artificial Sequence
  derived and/or modified sequence opt3 from neuraminidase__InfluenzaA__AHM98672
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaaacgucauuacguacgaaaauaacaccuggguuaaucagacauaugugaacaucagcaauacuaacuucgcugcagagcaguccguagugccugucaaacuggccggcaauucuucguugugcccagugucagggugggcgauauacagcaaggacaacaguauuagaaucggauccaaaggcgauguuuuugugauuagggaaccguucaucucuuguagccccuuagagugccggaccuuuuuccugacacagggugcucuacucaaugacaagcauuccaacgggaccaucaaagaucgcucaccuuaucgaacucugaugaguuguccaauuggagaaguccccagcccuuacaacucucguuuugaguccguggccuggucagcaagcgccugccacgacggcauaaauuggcuuacaaucggcauuagugggccagauaacggagcuguagcaguucugaaguauaaugguaucauaaccgacacgauuaagucuuggagaaacaauaucuugaggacucaagaguccgaaugugccugcgugaacggcagcuguuucaccaucaugacagaugggcccucggacggacaggcuucuuacaaaauuuuucggaucgagaagggcaaaauugucaaguccguggaaaugaaugccccuaacuaucauuacgaggagugcucauguuacccagauaguagcgaaauaacuugcgugugccgcgacaauuggcacgguuccaacagaccgugggucucuuucaaucagaaccucgaguaucagaucggguacauuuguagcggaaucuuuggcgauaaucccaggccuaacgacaaaaccggcucaugcgggccaguuaguuccaauggagcgaacggugugaagggcuucagcuuuaaguaugggaacggaguauggaucggccggacaaaaucuauuucaagucgcaaggguuucgaaaugauaugggaucccaauggguggaccggcacggacaacaauuuuagcaucaaacaagacauugugggaaucaacgagugguccggcuacucugggucguucguccagcauccugaacugacuggacuggauuguauucgaccaugcuucuggguggagcucaucagagguaggcccaaggagaauacaauauggaccagcggcuccucaaucaguuuuugugggguuaacucugacacugugggauggagcuggccggauggcgcagaauuaccuuucacaauugacaaauga

SEQ ID NO: 147189 - RNA, 1410 nt, Artificial Sequence
  derived and/or modified sequence opt3 from neuraminidase__InfluenzaA__AHM98683
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgacgcuggccaguccguagugucugucagacuggcaggaaauucgucauugugcccugugagcggaugggccauauacaguaaagauaacuccauuaggaucggcucuaagggugacguuuuugugauucgggagccauucaucagcuguuccccguuagaaugccgcaccuuuuuccugacacagggggcgcuacucaaugauaaacauucaaacggaaccaucaaggaccgaagucccuaucguacucugaugagcuguccuauuggcgaggucccaucucccuacaacuccagauuugaaucaguggcuuggagcgccagugcaugccacgauggcuucaauuggcuuacaauagggaucucuggaccugacaacggugccguagcuguucugaaauauaauggcauuaucaccgauacgauaagguccuggcggaacaauauuuugcgcacucaagagagcgagugugcaugcgugaacgggucguguuuuaccaucaugacagacggaccaucugauggccaggccuccuacaagaucuucagaauugaaaaggguaaaaucgucaagucaguggagaugaaugcucccaacuaucauuacgaagagugcaguuguuacccugacagcuccgagauuacuugcgugugcagggauaauuggcacgggucuaaccggccaugggucagcuuuaaucagaaccucgaauaucagauaggauacaucuguucaggcauuuucggcgacaauccgcgccccaacgauaaaaccgggaguugcggaccuguuuccagcaauggugccaacggcgugaagggguuuucuuucaaauauggaaacggcguauggaucggucgaacaaagucaaucaguagcagaaagggguuugagaugauuugggacccaaauggcuggaccggaacggacaacaauuucuccauaaaacaagauaucgugggcauuaacgaauggucuggguacucggggagcuucguccagcaucccgagcugacuggucuggacuguaucaggccuugcuuuuggguggaacucauucggggccguccaaaggagaauacaaucuggaccuccgggucaaguauaucuuucuguggaguuaacagcgauacugugggcugguccuggcccgacggugcggaguuaccguuuacaaucgauaaauga

SEQ ID NO: 147190 - RNA, 1410 nt, Artificial Sequence; identical to SEQ ID NO: 142725
  derived and/or modified sequence opt3 from neuraminidase__InfluenzaA__AHM98693

SEQ ID NO: 147191 - RNA, 1410 nt, Artificial Sequence; identical to SEQ ID NO: 145174
  derived and/or modified sequence opt3 from neuraminidase__InfluenzaA__AHM98704

SEQ ID NO: 147192 - RNA, 1410 nt, Artificial Sequence; identical to SEQ ID NO: 145174
  derived and/or modified sequence opt3 from neuraminidase__InfluenzaA__AHM98715

SEQ ID NO: 147193 - RNA, 1410 nt, Artificial Sequence; identical to SEQ ID NO: 142725
  derived and/or modified sequence opt3 from neuraminidase__InfluenzaA__AHM98726

SEQ ID NO: 147194 - RNA, 1410 nt, Artificial Sequence
  derived and/or modified sequence opt3 from neuraminidase__InfluenzaA__AHM98737
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuaacuacgaaaauaacacguggguuaaucagaccuaugugaacaucuccaauacaaacuucgcugcaggucagucuguagugucggucaaacuggccggcaauagcagcuugugcccugugagugggugggcgauauacuccaaggacaacucuauuaggaucggaagcaaaggcgauguuuuugugauucgggagccauucgucuccuguucaccguuagaaugccgcaccuuuuuccugacucagggugcucuacucaaugacaagcauaguaacgggacaaucaaagaucgaagccccuaucguacccugaugucuuguccuaucggagaggugccaucccccuacaacucaagauuugaaagcguagccuggagugcaucugccugccacgacggcauuaauuggcuuacuauaggcaucuccgggccugauaacggagcuguugcagugcugaaguauaaugguauuaucacagacaccauaaagagcuggaggaacgauauuuugcggacgcaagagucggagugugccugcgucaauggcucuuguuucacuaucaugaccgacgggccauccgauggacaggcuucauacaaaaucuuucgcauugaaaagggcaaaaucgugaagaguguggagaugaacgcccccaauuaucauuacgaagagugcagcuguuacccugacuccucugagauuacaugcgucugcagagauaacuggcacgguagcaauaggccauggguuucauucaaccagaaucucgaauaucagauaggguacaucuguaguggaauuuuuggcgacaacccgcggcccaaugauaaaacuggcuccugcgggccugugagcucuaacggagcgaaugguguaaagggcuucucauuuaaguaugggaacggaguguggaucggccgcaccaaaaguaucagcucccgaaaggguuucgagaugauuugggacccaaacggguggacaggcaccgacaauaacuuuucuauaaaacaagauaucgucggaauuaaugaauggucgggcuacagcggguccuucgugcagcaucccgagcugacgggacuggacuguaucagaccuugcuucuggguugaacucauuaggggucggccaaaggagaacacuaucuggacaucaggcaguucuauaucauuuuguggggucaauuccgauaccgugggauggucauggcccgacggcgcagaguuaccguucacuaucgauaaauga

SEQ ID NO: 147195 - RNA, 1410 nt, Artificial Sequence; identical to SEQ ID NO: 145174
  derived and/or modified sequence opt3 from neuraminidase__InfluenzaA__AHM98748

SEQ ID NO: 147196 - RNA, 1410 nt, Artificial Sequence; identical to SEQ ID NO: 145174
  derived and/or modified sequence opt3 from neuraminidase__InfluenzaA__AHM98759

SEQ ID NO: 147197 - RNA, 1410 nt, Artificial Sequence
  derived and/or modified sequence opt3 from neuraminidase__InfluenzaA__AHM98770
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgcuauuacguacgaaaacaauaccugggucaaccagacauauguuaauaucuccaacacuaauuucgcagccggucagucugugguaucggugaaacuggcgggcaacucauccuugugcccugucagugggugggcuauauacuccaaggacaauucuauuaggaucggaagcaaaggcgauguguuuguuauucgggagccauucaucuccuguucaccguuagaaugccgcaccuuuuuccugacacagggugcccuacucaacgacaagcauaguaaugggaccaucaaagaucgaagccccuaucguacucugaugucuuguccuauuggagaggugccaucccccuacaacucaagauuugaaagcgucgcauggagugccucugcuugccacgacggcauaaacuggcuuacaaucggcauuuccgggccugauaauggagcaguggccguacugaaguauaacgguaucauaaccgacacgauuaagagcuggaggaauaacaucuugcggacucaagagucggagugugcuugcguuaauggcucuuguuucaccaucaugacagaugggccauccgacggacaggccucauacaaaauuuuucgcaucgaaaagggcaaaauugugaagagugucgagaugaacgcgcccaauuaucauuacgaagagugcagcuguuacccugauuccucugagauaacuugcgugugcagagacaacuggcacgguagcaauaggccaugggugucauucaaccagaaucucgaauaucagaucggguacauuuguaguggaaucuuuggcgauaacccgcggcccaaugacaaaaccggcuccugcgggccugucagcucuaacggagcaaaugguguuaagggcuucucauuuaaguaugggaacggaguguggaucggccgcacaaaaaguauuagcucccgaaaggguuucgagaugauaugggauccaaacggguggaccggcacggacaauaacuuuucuaucaaacaagacauuguaggaaucaaugaauggucgggcuacagcggguccuucgugcagcaucccgagcugacuggacuggauuguauuagaccuugcuucugggucgaacucaucaggggucggccaaaggagaacacaauauggaccucaggcaguucuaucagcuuuuguggggugaauagcgacacuguuggauggucauggcccgauggcgccgaguuaccguucacaauugacaaauga

SEQ ID NO: 147198 - RNA, 1410 nt, Artificial Sequence
  derived and/or modified sequence opt3 from neuraminidase__InfluenzaA__AHM98781
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccagugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauucuuuuucgaucaaacaagacauugugggcaucaacgaauggagcggguacuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucaggcacuguggguuggagcuggcccgacggggcagaguuaccguucacaauugauaaauga

SEQ ID NO: 147199 - RNA, 1410 nt, Artificial Sequence; identical to SEQ ID NO: 142725
  derived and/or modified sequence opt3 from neuraminidase__InfluenzaA__AHM98801

SEQ ID NO: 147200 - RNA, 1410 nt, Artificial Sequence; identical to SEQ ID NO: 142273
  derived and/or modified sequence opt3 from neuraminidase__InfluenzaA__AHM98812

SEQ ID NO: 147201 - RNA, 1410 nt, Artificial Sequence
  derived and/or modified sequence opt3 from neuraminidase__InfluenzaA__AHM98823
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauauaucaauauauccaacacuaauuucgcugcaggccagucugugguaucggugaaacuggccgggaacucaucauugugcccugucaguggaugggcgauuuacuccaaggacaauucuaucagaauuggcagcaaaggugauguguuuguuaucagggagccauucaucuccuguucaccgagugaaugccggaccuuuuucuuaacacagggggcucugcuaaacgacaagcauagcaauggaaccauuaaagaucgcucucccuaucgaacucucauguccuguccuauaggcgaggugccaucacccuacaacagccguuuugaaagugucgccuggucugcauccgccugccacgacggcaucaacuggcugacaauugggaucagcggaccugauaauggugcuguggcaguacuuaaguauaacggcauaauuaccgacacgaucaagucguggagaaauaacauccugaggacucaagagucugagugugccugcguuaauggguccuguuucaccauuaugacagauggaccaucagacggccaggcuaguuacaaaaucuuucggauugaaaaggguaaaauagucaagagcguggagaugaacgcccccaauuaucauuacgaagagugcuccuguuacccugauucuagcgagaucacuugcgugugccgcgacaacuggcacgggucaaauagaccaugggugaguuucaaccagaauuuggaauaucagauuggauacaucuguuccggcaucuuuggcgauaacccgaggcccaaugacaaaaccgggagcugcggaccugucucuucaaacggugcgaauggcguuaagggguucaguuuuaaguauggaaacggcguguggauuggucggacaaaaagcauauccucucgcaagggguucgagaugaucugggauccaaacggcuggaccggaacggacaauaacuuuucgauuaaacaagacaucguaggcauuaaugaauggagcggguacuccggaucauucgugcagcaucccgagcucacuggucuggauuguauccgaccuugcuucugggucgaacugauaagaggcaggccaaaggagaacacaaucuggaccagugggucuagcauuuccuuuuguggagugaauagcgacacuguuggcuggagcuggcccgauggugcagagcucccguucacaaucgacaaauga

SEQ ID NO: 147202 - RNA, 1410 nt, Artificial Sequence
  derived and/or modified sequence opt3 from neuraminidase__InfluenzaA__AHM98839
augaaccccaaucagaagaucauuaccauaggcagcgugugcaugacagucgggauggccaaccugauccuccaaauuggaaauaucauuuccaucuggauaucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcagcuugugcccuguuaguggaugggcgaucuacuccaaggacaauucuauaagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauaauggugcuguugcagugcugaaguauaacggcauuaucaccgacacgauaaagagcuggagaaauaacauuuugaggacucaagagucggagugugccugcgucaaugggucuuguuucaccaucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaagggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 147203 - RNA, 1410 nt, Artificial Sequence; identical to SEQ ID NO: 142273
  derived and/or modified sequence opt3 from neuraminidase__InfluenzaA__AHM98850

SEQ ID NO: 147204 - RNA, 1410 nt, Artificial Sequence; identical to SEQ ID NO: 142273
  derived and/or modified sequence opt3 from neuraminidase__InfluenzaA__AHM98861

SEQ ID NO: 147205 - RNA, 1410 nt, Artificial Sequence
  derived and/or modified sequence opt3 from neuraminidase__InfluenzaA__AHM98901
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguccccaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuucaccaucaugacagauggaccaucugacggccaggcuuccuauaaaauuuuucggaucgaaaaggguaaaauugucaagucaguggagaugaaugcccccaacuaccacuaugaagagugcaguuguuacccugauagcuccgagauaacuugcgugugccgcgacaauuggcaugggucuaacagaccaugggucagcuucaaucagaaccucgaauaccagaucggauauauuuguucaggcaucuuuggcgauaauccgaggcccaacgacaaaaccgggaguugcggaccuguuuccagcaauggugcgaacggcgugaagggguucucuuuuaaguacggaaacggcguauggaucggucggacaaaaucaauuaguagccgcaagggguucgagaugauaugggauccaaauggcuggaccggaacggacaacaauuuuuccaucaaacaagacauugugggcaucaacgaauggucuggguauucggggagcuucguccagcaccccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 147206 - RNA, 1410 nt, Artificial Sequence; identical to SEQ ID NO: 145862
  derived and/or modified sequence opt3 from neuraminidase__InfluenzaA__AHM98912

SEQ ID NO: 147207 - RNA, 1410 nt, Artificial Sequence; identical to SEQ ID NO: 145862
  derived and/or modified sequence opt3 from neuraminidase__InfluenzaA__AHM98923

SEQ ID NO: 147208 - RNA, 1410 nt, Artificial Sequence; identical to SEQ ID NO: 145862
  derived and/or modified sequence opt3 from neuraminidase__InfluenzaA__AHM98935

SEQ ID NO: 147209 - RNA, 1410 nt, Artificial Sequence; identical to SEQ ID NO: 145862
  derived and/or modified sequence opt3 from neuraminidase__InfluenzaA__AHM98943

SEQ ID NO: 147210 - RNA, 1410 nt, Artificial Sequence; identical to SEQ ID NO: 145862
  derived and/or modified sequence opt3 from neuraminidase__InfluenzaA__AHM98954

SEQ ID NO: 147211 - RNA, 1410 nt, Artificial Sequence; identical to SEQ ID NO: 145862
  derived and/or modified sequence opt3 from neuraminidase__InfluenzaA__AHM98972

SEQ ID NO: 147212 - RNA, 1410 nt, Artificial Sequence; identical to SEQ ID NO: 145862
  derived and/or modified sequence opt3 from neuraminidase__InfluenzaA__AHM98978

SEQ ID NO: 147213 - RNA, 1410 nt, Artificial Sequence; identical to SEQ ID NO: 145862
  derived and/or modified sequence opt3 from neuraminidase__InfluenzaA__AHM98990

SEQ ID NO: 147214 - RNA, 1410 nt, Artificial Sequence; identical to SEQ ID NO: 145862
  derived and/or modified sequence opt3 from neuraminidase__InfluenzaA__AHM99000

SEQ ID NO: 147215 - RNA, 1410 nt, Artificial Sequence; identical to SEQ ID NO: 145862
  derived and/or modified sequence opt3 from neuraminidase__InfluenzaA__AHM99011

SEQ ID NO: 147216 - RNA, 1410 nt, Artificial Sequence; identical to SEQ ID NO: 145838
  derived and/or modified sequence opt3 from neuraminidase__InfluenzaA__AHM99022

SEQ ID NO: 147217 - RNA, 1410 nt, Artificial Sequence; identical to SEQ ID NO: 145838
  derived and/or modified sequence opt3 from neuraminidase__InfluenzaA__AHM99034

SEQ ID NO: 147218 - RNA, 1410 nt, Artificial Sequence; identical to SEQ ID NO: 145838
  derived and/or modified sequence opt3 from neuraminidase__InfluenzaA__AHM99046

SEQ ID NO: 147219 - RNA, 1410 nt, Artificial Sequence; identical to SEQ ID NO: 145838
  derived and/or modified sequence opt3 from neuraminidase__InfluenzaA__AHM99057

SEQ ID NO: 147220 - RNA, 1410 nt, Artificial Sequence; identical to SEQ ID NO: 145838
  derived and/or modified sequence opt3 from neuraminidase__InfluenzaA__AHM99068

SEQ ID NO: 147221 - RNA, 1410 nt, Artificial Sequence; identical to SEQ ID NO: 145862
  derived and/or modified sequence opt3 from neuraminidase__InfluenzaA__AHM99078

SEQ ID NO: 147222 - RNA, 1410 nt, Artificial Sequence
  derived and/or modified sequence opt3 from neuraminidase__InfluenzaA__AHN00720
augaacaccaaucagagaaucauuacaauaggcacuaucugccugauuguggggaucauuagccuccuucugcaaaucggaaacauagucuccuuguggaucucucacucaauucagacggaggaaaagagucaucccgagguuuguaaucagagcgugaucaccuacgaaaacaauacauggguaaaccagacuuauauuaauaucuccaacaccaauauagccgcuggucaaggcgugacaccuauuaucuuagcagggaacucuucgcugugcccaauuucaggaugggccaucuacagcaaagacaauaguaucaggauuggcuccaagggugauauauucgucaugcgggagccguuuaucucuuguagccaccuagaaugccgcaccuucuuucucacucagggggcgcugcuuaacgaccgacauuccaauggaacagugaaagaucguucacccuauagaacccugaugaguuguccuauuggcgaggcuccaagccccuacaacucuagguucgaguccguugccuggucagcaagcgccugccacgacggcauggggugguugacgaucggaauaagugguccugauaauggcgcuguggcaguccucaaguauaacgggauuaucacugacaccaugaaaucuuggcggaacaagauccugcgcacacaggaauccgagugugugugcauuaauggaagcuguuuuacuaucaugaccgauggcccaucgaacggucaggccucuuacaagauuuucaaaauggaaaaggggaaaauaaucaaguccauugagcuggacgcucccaauuaucauuacgaggaaugcucauguuacccugauacaggaaaaguaguuugcgugugcagagacaacuggcacgccaguaauaggccaugggucagcuuugaucaaaaccucgacuaucagaucggcuacaucuguuccggcguguucggggauaauccgcggucuaacgacggaaaggguaauugcggccccguguuaagcaacggggcgaauggagucaagggcuuuucauuccgcuaugguaacgggguuuggauuggccgaaccaaaaguauauccagcagaucuggauuugagaugaucugggacccuaauggcuggacggaaacugauucaaguuucagcaugaagcaggacauuaucgcacugacagauugguccggguacucuggaucguuugugcagcacccagagcuuaccgguaugaacuguauuaggcccugcuucuggguagaauugauccggggccaaccuaaagagagcacuauauggacauccgggucaaguaucucuuucuguggagugaauagcgagaccgccuccuggucauggccagacggcgcugaucugcccuuuacgauugacaaguga

SEQ ID NO: 147223 - RNA, 1410 nt, Artificial Sequence
  derived and/or modified sequence opt3 from neuraminidase__InfluenzaA__AHN00767
augaacaccaaucagagaaucauuacaauaggcacuaucugccugauuguggggaucauuagccuccuucugcaaaucggaaacauagucuccuuguggaucucucacucaauucagacgggugagaagagucaucccgaaguuuguaaucagagcgugaucaccuacgagaacaauacauggguaaaccagacuuaugugaauauuuccaacaccaauaucgccgcuggccaaggggucacaccuauaauuuuagcaggaaacucuucgcugugcccaaucucaggcugggccauuuacagcaaagacaauaguaucaggaucgguuccaagggggauauuuucgugaugcgggaaccguuuauaucuuguagccaccuagagugccgcaccuucuuucucacucagggagcgcugcuuaacgaccgacauuccaauggcacaguuaaagaucguucacccuauagaacccugaugaguuguccuaucggcgaagcuccaagccccuacaacucuagguucgaguccguggccuggucagcaagcgccugccacgacgggaugggaugguugacgauugguaucaguggcccugauaauggggcugucgcagugcucaaguauaacggaauaauuacugacaccaucaaaucuuggcggaacaagauccugcgcacacaggaguccgaauguguaugcauuaauggcagcuguuuuacuaucaugaccgaugguccaucgaacgggcaggccucuuacaagauuuucaaaauggagaagggaaaaauaaucaaguccauugaacuggacgcucccaauuaucauuacgaggagugcucauguuacccugauacaggcaaaguugugugcgucugcagagacaacuggcacgccaguaauaggccaugggugagcuuugaucaaaaccucgacuaucagaucggcuacaucuguuccgggguguucggagauaauccgcggucuaacgacgguaagggcaauugcgggcccgucuuaagcaacggagcgaauggcguuaaggguuuuucauuccgcuaugggaacggcguguggauuggacgaaccaaaaguauauccagcagaucuggcuuugaaaugaucugggacccuaauggguggacggagacugauucaaguuucagcaugaagcaggacauuaucgcacugacagauugguccggauacucugguucguuuguacagcacccagaacuuaccggcaugaacuguauuaggcccugcuucuggguggaguugauccgggggcaaccuaaagaaagcacuauauggacauccggaucaaguaucucuuucuguggcgucaauagcgagaccgccuccuggucauggccagacggugcugaucugcccuuuacgauugacaaguga

SEQ ID NO: 147224 - RNA, 1398 nt, Artificial Sequence
  derived and/or modified sequence opt3 from neuraminidase__InfluenzaA__AHN96324
augaaccccaaucagaagauccugugcaccagcgccacagcuauuauaaucggcgcaauugccgugcucaucgggauugcgaaccuuggacugaauaucgguuugcacuuaaaaccuuccuguaacugcucucauucacaaccagagacuacgaauaccagucagacaauaaucaacaauuacuauaacgaaacuaauauuaccaacauccagauggaggaaagaacaagcaggaauuucaacaaucugaccaagggccuauguacuauuaacuccuggcacaucuacgggaaagacaaugcuguccggauaggagagucuucggauguucucgugacacgcgaaccguauguaucaugcgaccccgaugagugucgauuuuacgcccugagccagggcaccacgauucgugguaagcauaguaacgggacuauccacgacagaucccaauauagggcacuuauuucuuggccucugagcuccccacccaccguguacaacucacgggucgagugcaucggauggaguagcacaucuugucaugauggcaaaucccgcaugucaaucugcauuagcggcccuaauaacaaugccagugcugugguuugguauaacagaaggccaguggcagaaauaaauacuugggcccggaacaucuugcgcacccaggagucugaaugugucugccacaauggggugugucccguaguuuucacagacggauccgcuaccgguccugccgauacgcgaauuuacuacuuuaaggagggcaagauccucaaaugggagagccugacugggacagcgaagcacauagaagagugcucgugcuauggagaaagaaccggcauuacuuguacaugcagggacaacuggcaggguucuaaucggccagugguccagaucgauccgguggcaaugacccauacgucccaauacaucuguucacccgugcugaccgacaacccucguccaaaugaucccaacauugggaaaugcaaugacccuuauccaggaaacaauaacaacggcgucaagggcuucaguuaccucgauggggccaauacaugguuaggacgcacuaucagcaccgcuuccagaucugguuaugagaugcugaaaguucccaacgcccuuacagacgacaggagcaagccgauucagggccagacuauaguguugaaugcagauuggucaggguacaguggauccuuuauggacuauugggcugaaggcgauuguuaccgggccugcuucuacguagagcugauccgaggucgcccuaaggaggacaaagugugguggaccagcaacucuauugucucaauguguaguagcacagaauuucuagggcaguggaauuggcccgauggcgcgaagaucgaguauuuccucuga

SEQ ID NO: 147225 - RNA, 1410 nt, Artificial Sequence; identical to SEQ ID NO: 143159
  derived and/or modified sequence opt3 from neuraminidase__InfluenzaA__AHN96448

SEQ ID NO: 147226 - RNA, 1410 nt, Artificial Sequence; identical to SEQ ID NO: 144162
  derived and/or modified sequence opt3 from neuraminidase__InfluenzaA__AHN96450

SEQ ID NO: 147227 - RNA, 1410 nt, Artificial Sequence
  derived and/or modified sequence opt3 from neuraminidase__InfluenzaA__AHN96451
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucauguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuauguaucgugcgacccagauaaguguuaccaauucgcgcuggggcagggaacgacucuaaauaacgugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcagugcccaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccauuaaugagacaagcagacuugguuaugagacuuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaaccgaggugcuauggacaaguaauagcaucgucguguucuguggcacuuccggaaccuacggcacagggucuuggccugauggagccgaccucaaccugaugccaauuuga

SEQ ID NO: 147228 - RNA, 1410 nt, Artificial Sequence
  derived and/or modified sequence opt3 from neuraminidase__InfluenzaA__AHN96453
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuagacaauguccauucaaacaauaccgugcgaaaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuauugaagguaaaucauguaucaaccgcugcuuuuauguugagcugaucagagggaggaaggaagagaccgaagugcuauggacaaguaauagcauugucguguucuguggcacuuccggaaccuacggcacagggucuuggccugacggagccgaucucaaccugaugccaauauga

SEQ ID NO: 147229 - RNA, 1410 nt, Artificial Sequence
  derived and/or modified sequence opt3 from neuraminidase__InfluenzaA__AHZ13526
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacaugacugaaauuguauauuugaccaauacaaccaucgagaaggaaauuuguccuaaauuaguggaguacaggaacuggaguaagccacagugcaaaaucacuggguucgcacccuuuagcaaggacaauuccauacggcugucugccggaggugauauuugggucacacgcgagccuuaugugucgugugacccaggcaagugcuaccaauucgcgcuagggcagggaaccacgcucaacaauaaacauucaaacgauacuauccacgaccgaacccccuaucguacacugcuuaugaaugaacugggcguuccuuuucauuuggguacuaaacagguguguauugcuuggagcaguuccucuugccacgaugggaaggccuggcuccaugucugugugaccggacacgacaagaacgcaacagccagcuucaucuacgauggcagacugguagacuccaucggcucauggaguaaaaauauucugaggacccaggagagcgaaugcguuuguauaaacgggacgugcacuguggucaugacagauggaucugcuuccgaccgggcagauaccaagauccucuuuauugaggaggguaagaucgugcacauaucaccauuaagcggcagugcccaacauguggaagagugcucuuguuauccgcgcuaccccggggucagaugcguuuguagggacaauuggaaaggauccaaccggccuauuguggauaucaacguaaaggacuacagcaucgugucgucuuaugucugcuccggccuggugggugacacuccacgcaaaaaugaugggucaaguagcuccuacugucgaaaccccaauaacgaaaagggaaaucacggcguuaaaggcugggcuuucgacgaugggaacgacguguggaugggaagaacaauuggugaggaacuuaggucuggcuaugagaccuuuaaggucaucgggggauggagcacgccuaauucaaaauugcagauuaaccgucaggugauaguagauaguaauaaccgguccggcuacagcgguaucuucucuguugaggggaagucaugcauuaaucgcuguuuuuauguggaacugaucagaggcagggagcaggaaacccgggucugguggacaaguaacagcaucguggucuucugcggaacuuccggcaccuacgggacaggaucuuggccagacggugccgauauuaaucuaaugcccauauga

SEQ ID NO: 147230 - RNA, 1413 nt, Artificial Sequence; identical to SEQ ID NO: 142221
  derived and/or modified sequence opt3 from neuraminidase__InfluenzaA__AHZ13584

SEQ ID NO: 147231 - RNA, 1410 nt, Artificial Sequence; identical to SEQ ID NO: 144938
  derived and/or modified sequence opt3 from neuraminidase__InfluenzaA__AHZ35575

SEQ ID NO: 147232 - RNA, 1410 nt, Artificial Sequence; identical to SEQ ID NO: 144938
  derived and/or modified sequence opt3 from neuraminidase__InfluenzaA__AHZ35587

SEQ ID NO: 147233 - RNA, 1410 nt, Artificial Sequence
  derived and/or modified sequence opt3 from neuraminidase__InfluenzaA__AHZ35611
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggccgcucauguauuaacagaugcuuuuauguggaacugaucaggggucggaaagaggaaaccgagguccuauggacaaguaauagcaucguggucuucugugggacuuccggcaccuacggaacaggcucuuggccugacggggccgaucucaaccugaugccaauuuga

SEQ ID NO: 147234 - RNA, 1410 nt, Artificial Sequence; identical to SEQ ID NO: 144938
  derived and/or modified sequence opt3 from neuraminidase__InfluenzaA__AHZ35623

SEQ ID NO: 147235 - RNA, 1410 nt, Artificial Sequence; identical to SEQ ID NO: 144938
  derived and/or modified sequence opt3 from neuraminidase__InfluenzaA__AHZ35635

SEQ ID NO: 147236 - RNA, 1410 nt, Artificial Sequence
  derived and/or modified sequence opt3 from neuraminidase__InfluenzaA__AHZ35647
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccggacguuagaugugugugcagggauaacuggaagggcuccaaucggcccauaguagacauuaacaucaaagaccacagcaucgugucgucuuacgucuguuccggguuagugggagauacgccucgcaagaaugacucaaguagcuccucucauugccuggauccaaacaaugaggaaggcggucacgggguuaaaggaugggcuuucgacgauggcaacgacguguggaugggccgaaccauuaaugagacaagcagacuuggguaugagacuuuuaaggucaucgaaggauggucaaaccccaaaaguaaguugcagauuaauaggcaagugauaguagaucggggugaccguuccggcuacagcgggaucuucucuguugagggaaaaucauguauuaaccgcugcuuuuauguggaacugaucagaggcaggaaggaggaaaccgagguccuauggacaaguaauagcaucguggucuucugugguacuuccgggaccuacggcacaggaucuuggccugauggcgccgaccucaaccugaugccaauuuga

SEQ ID NO: 147237 - RNA, 1410 nt, Artificial Sequence; identical to SEQ ID NO: 144938
  derived and/or modified sequence opt3 from neuraminidase__InfluenzaA__AHZ35659

SEQ ID NO: 147238 - RNA, 1410 nt, Artificial Sequence; identical to SEQ ID NO: 144938
  derived and/or modified sequence opt3 from neuraminidase__InfluenzaA__AHZ35671

SEQ ID NO: 147239 - RNA, 1410 nt, Artificial Sequence; identical to SEQ ID NO: 144938
  derived and/or modified sequence opt3 from neuraminidase__InfluenzaA__AHZ35683

SEQ ID NO: 147240 - RNA, 1410 nt, Artificial Sequence
  derived and/or modified sequence opt3 from neuraminidase__InfluenzaA__AHZ35695
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaaccagcugaguacaggaauuggucaaagccccagugugacauaacaggguucgcaccuuuuaguaaagauaacagcauucgguuauccgccggaggugacaucuggguaacccgcgagccauaugugucuugcgaucccgacaaguguuaccaauucgcgcugggccaggggacgacucuaaauaacguccauucgaauaacaccgugcgagaucguacaccuuauagaacucuccugaugaaugaacuuggaguuccauuucaccugggcaccaaacaggugugcauugcuuggucaagcaguuccugucaugacgguaaggccugguugcacgucugcaucacaggggaugacaagaacgcaaccgccucuuucaucuacaaugagaggcucguggauagcguaguuuccuggucaaaagaaauucugcggacgcaggagagugagugugugugcauaaacggaacuuguacagucgugaugaccgacggcagcgcuucuggcaaggcagauacuaaaauccuguuuauugaagaggggaagaucgugcauacauccacccucucaggaagcgcccaacacgucgaagagugcaguugcuauccgcgcuaccccgguguuagaugugugugcagggacaacuggaagggcucuaaucggccuauaguagauauuaacaucaaagaccacuccaucgugagcucguacgucuguucuggguuagugggagacacgccacgcaagaaugauuccucaaguagcucccauugccuggaccccaacaaugaagagggcggucacgggguuaaaggaugggcuuucgaugacggcaacgauguguggaugggccgaaccauuaaugagacaucuagacuuggguaugaaacuuuuaaggucaucgagggauggagcaacccuaaaucaaaguugcagauuaauaggcaagugauaguagaccggggugaucguaguggcuacuccgggaucuucagcguugaaggaaacucuuguauuaaucgcugcuuuuauguggagcugaucagaggcaggaaagaagagaccgagguccuauggacaucaaacaguaucguggucuucugugguacuagcgggaccuacggcacaggauccuggccagacggcgccgaucucaaucugaugcccauuuga

SEQ ID NO: 147241 - RNA, 1410 nt, Artificial Sequence
  derived and/or modified sequence opt3 from neuraminidase__InfluenzaA__AHZ35719
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgaucucaaccugaccccaauuuga

SEQ ID NO: 147242 - RNA, 1410 nt, Artificial Sequence; identical to SEQ ID NO: 144938
  derived and/or modified sequence opt3 from neuraminidase__InfluenzaA__AHZ35731

SEQ ID NO: 147243 - RNA, 1410 nt, Artificial Sequence; identical to SEQ ID NO: 144938
  derived and/or modified sequence opt3 from neuraminidase__InfluenzaA__AHZ35743

SEQ ID NO: 147244 - RNA, 1410 nt, Artificial Sequence; identical to SEQ ID NO: 144938
  derived and/or modified sequence opt3 from neuraminidase__InfluenzaA__AHZ35755

SEQ ID NO: 147245 - RNA, 1410 nt, Artificial Sequence; identical to SEQ ID NO: 144938
  derived and/or modified sequence opt3 from neuraminidase__InfluenzaA__AHZ35767

SEQ ID NO: 147246 - RNA, 1410 nt, Artificial Sequence; identical to SEQ ID NO: 144938
  derived and/or modified sequence opt3 from neuraminidase__InfluenzaA__AHZ35779

SEQ ID NO: 147247 - RNA, 1410 nt, Artificial Sequence
  derived and/or modified sequence opt3 from neuraminidase__InfluenzaA__AHZ35803
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcggaugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugauaacggugcuguagcaguucuuaaguauaauggcaucauaaccgacacgauuaaauccuggagaaacaauauccugaggacucaggagagcgagugugccugcgugaacgggucguguuucaccaucaugacagauggaccaucugacggccaggcuuccuacaagauuuuucggaucgaaaaagguaagauugucaaaucaguggagaugaaugcccccaacuaucauuacgaagagugcaguuguuacccugauagcuccgagauaacuugcgugugccgcgacaauuggcacgggucuaacagaccaugggucagcuucaaucaaaacuuggaauaucagaucggauacauuuguucaggcaucuuuggcgauaauccgaggccccaugacaagaccgggaguugcggaccuguuuccagcaacggugcgaauggcgugaagggguucucuuuuaaauauggaaacggcguauggaucggucggacaaagucaauuaguagccgcaaaggguucgagaugauaugggauccaaacggcuggaccggaacggacaauaacuuuuccaucaagcaggacauugugggcaugaaugaauggucuggguacucggggagcuucguccaacaccccgagcucacuggucuggauuguauccgaccuugcuucuggguggaacugauuagaggcaggccaaaagagaacacaaucuggaccuccgggucaaguauaucuuuuuguggaguuaauagcgacacugugggcugguccuggcccgauggugcagagcucccguucacaaucgacaaguga

SEQ ID NO: 147248 - RNA, 1410 nt, Artificial Sequence
  derived and/or modified sequence opt3 from neuraminidase__InfluenzaA__AHZ35814
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugaccuauggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcaucgcuuggagcaguuccucuugucaugacgguaaggccuggcugcacgucugcauuacaggggaugacaagaacgcaaccgccagcuucaucuacaauggaaggcugguggauuccguaguuucauggaguaaagagauccuccggacgcaggaaagcgagugugugugcauuaacggcacuuguacagucgugaugaccgacggcucugcuuccgggaaggcagauacuaaaauauuauuuaucgaggaaggaaagauugugcauacaucaacccugagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuucgaugacggcaacgauguguggauggggcgaaccaucaaugagacaagcagacugggauaugagacuuuuaaggucauugaagguuggucaaacccaaaaaguaagcuacagaucaauaggcaagugauuguagaccggggcaaccguuccggguacagcggaauauucucuguugagggcaaaucauguaucaaucgcugcuuuuauguggaacucauuagagguaggaaggaggaaaccgagguccuguggacaaguaacagcaucguggucuucugugggacuuccggcaccuacggaacaggcucuuggcccgauggggccgaccuuaaucugaugccuaucuga

SEQ ID NO: 147249 - RNA, 1410 nt, Artificial Sequence
  derived and/or modified sequence opt3 from neuraminidase__InfluenzaA__AHZ35837
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcggaugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugauaacggugcuguagcaguucuuaaguauaauggcaucauaaccgacacgauuaaauccuggagaaacaauauccugaggacucaggagagcgagugugccugcgugaacgggucguguuucaccaucaugacagauggaccaucugacggccaggcuuccuacaagauuuuucggaucgaaaaagguaagauugucaaaucaguggagaugaaugcccccaacuaucauuacgaagagugcaguuguuacccugauagcuccgagauaacuugcgugugccgcgacaauuggcacgggucuaacagaccaugggucagcuucaaucaaaacuuggaauaucagaucggauacauuuguucaggcaucuuuggcgauaauccgaggccccaugacaagaccgggaguugcggaccuguuuccagcaacggugcgaauggcgugaagggguucucuuuuaaauauggaaacggcguauggaucggucggacaaagucaauuaguagccgcaaaggguucgagaugauaugggauccaaacggcuggaccggaacggacaauaacuuuuccaucaagcaggacauugugggcaucaaugaauggucuggguacucggggagcuucguccaacaccccgagcucacuggucuggauuguauucgaccuugcuucuggguggaacugaucagaggcaggccaaaagagaacacaauauggaccuccgggucaaguaucucuuuuuguggaguuaauagcgacacugugggcugguccuggcccgauggugcagagcucccguucacaauugacaaguga

SEQ ID NO: 147250 - RNA, 1410 nt, Artificial Sequence; identical to SEQ ID NO: 147249
  derived and/or modified sequence opt3 from neuraminidase__InfluenzaA__AHZ35848

SEQ ID NO: 147251 - RNA, 1410 nt, Artificial Sequence; identical to SEQ ID NO: 147249
  derived and/or modified sequence opt3 from neuraminidase__InfluenzaA__AHZ35859

SEQ ID NO: 147252 - RNA, 1410 nt, Artificial Sequence; identical to SEQ ID NO: 147248
  derived and/or modified sequence opt3 from neuraminidase__InfluenzaA__AHZ35870

SEQ ID NO: 147253 - RNA, 1410 nt, Artificial Sequence; identical to SEQ ID NO: 147248
  derived and/or modified sequence opt3 from neuraminidase__InfluenzaA__AHZ35882

SEQ ID NO: 147254 - RNA, 1410 nt, Artificial Sequence
  derived and/or modified sequence opt3 from neuraminidase__InfluenzaA__AHZ35894
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcgggugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugauaacggugcuguagcaguucuuaaguauaauggcaucauaaccgacacgauuaaauccuggagaaacaauauccugaggacucaggagagcgagugugccugcgugaacgggucguguuucaccaucaugacagauggaccaucugacggccaggcuuccuacaagauuuuucggaucgaaaaagguaagauugucaaaucaguggagaugaaugcccccaacuaucauuacgaagagugcaguuguuacccugauagcuccgagauaacuugcgugugccgcgacaauuggcacgggucuaacagaccaugggucagcuucaaucaaaacuuggaauaucagaucggauacauuuguucaggcaucuuuggcgauaauccgaggccccaugacaagaccgggaguugcggaccuguuuccagcaacggugcgaauggcgugaagggguucucuuuuaaauauggaucaggcguauggaucggucggacaaagaguauuagcucccgcaaaggguucgagaugauaugggauccaaacggcuggaccggaacggacaacaauuuuucuaucaagcaggacauugugggcaucaacgaauggucgggguacagcggauccuucguccaacaccccgagcucacuggucuggauuguauucgaccuugcuucuggguggaacugaucagaggcaggccaaaagagaauacaauauggaccucagggaguucuaucagcuuuuguggaguuaacuccgacacugugggcuggucauggcccgauggugcagagcucccguucacaauugacaaguga

SEQ ID NO: 147255 - RNA, 1410 nt, Artificial Sequence; identical to SEQ ID NO: 147249
  derived and/or modified sequence opt3 from neuraminidase__InfluenzaA__AHZ35905

SEQ ID NO: 147256 - RNA, 1410 nt, Artificial Sequence; identical to SEQ ID NO: 147249
  derived and/or modified sequence opt3 from neuraminidase__InfluenzaA__AHZ35916

SEQ ID NO: 147257 - RNA, 1410 nt, Artificial Sequence; identical to SEQ ID NO: 142974
  derived and/or modified sequence opt3 from neuraminidase__InfluenzaA__AHZ35927

SEQ ID NO: 147258 - RNA, 1410 nt, Artificial Sequence
  derived and/or modified sequence opt3 from neuraminidase__InfluenzaA__AHZ35938
augaaccccaaucagaagaucauuaccauaggcagcgugugcaugaucauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacuauuaugaccgauggaccaucugacggccaggcuuccuacaaaaucuuucggauugaaaaggguaaaauagucaagucaguggagaugaaugcccccaacuaucauuacgaagagugcaguuguuacccugauagcuccgagaucacaugcgugugccgcgacaauuggcacgggucuaacagaccaugggucagcuucaaucagaaccucgaauaucagauuggauacaucuguucaggcaucuuuggcgauaauccgaggccccaugacaaaacugggaguugcggaccuguuuccagcaacggugcgaauggcgugaagggguucucuuuuaaguauggaaacggcguauggauuggucggaccaaaucaauaaguagccgcaagggguucgagaugaucugggauccaaacggcuggacaggaaccgacaauaacuuuuccauuaaacaagacaucgugggcauuaaugaauggucuggguacucggggagcuucguccagcaccccgagcugacgggucuggauuguauccgaccuugcuucuggguggaacucauaagaggcaggccaaaggagaacacuaucuggacauccgggucaaguauuucuuuuuguggaguuaauagcgacaccgugggcugguccuggcccgauggugcagaguuaccguucacuaucgacaaauga

SEQ ID NO: 147259 - RNA, 1410 nt, Artificial Sequence; identical to SEQ ID NO: 147248
  derived and/or modified sequence opt3 from neuraminidase__InfluenzaA__AHZ35949

SEQ ID NO: 147260 - RNA, 1410 nt, Artificial Sequence
  derived and/or modified sequence opt3 from neuraminidase__InfluenzaA__AHZ35961
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcggaugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugauaacggugcuguagcaguucuuaaguauaauggcaucauaaccgacacgauuaaauccuggagaaacaauauccugaggacucaggagagcgagugugccugcgugaacgggucguguuucaccaucaugacagauggaccaucugacggccaggcuuccuacaagauuuuucggaucgaaaaagguaagauugucaaaucaguggagaugaaugcccccaacuaucauuacgaagagugcaguuguuacccugauagcuccgagauaacuugcgugugccgcgacaauuggcacgggucuaacagaccaugggucagcuucaaucaaaacuuggaauaucagaucggauacauuuguucaggcaucuuuggcgauaauccgaggccccaugacaagaccgggaguugcggaccuguuuccagcaacggugcgaauggcgugaagggguucucuuuuaaauauggaaacggcguauggaucggucggacaaagucaauuaguagccgcaaaggguucgagaugauaugggauccaaacggcuggaccggaacggacaauaacuuuuccaucaagcaggacauugugggcaucaaugaauggucuggguacucggggagcuucguccaacaccccgagcucacuggucuggauuguauucgaccuugcuucuggguggaacugaucagaggcaggccaaaagaguccacaauauggaccucagggaguucuaucagcuuuuguggaguuaacuccgacacugugggcuggucauggcccgauggugcagagcucccguucacaauugacaaguga

SEQ ID NO: 147261 - RNA, 1410 nt, Artificial Sequence; identical to SEQ ID NO: 147249
  derived and/or modified sequence opt3 from neuraminidase__InfluenzaA__AHZ35972

SEQ ID NO: 147262 - RNA, 1410 nt, Artificial Sequence
  derived and/or modified sequence opt3 from neuraminidase__InfluenzaA__AHZ35983
augaaccccaaucagaagaucaccacaauuggcagcgugugcaugacuauagggauggccaaccugaugcuccaaaucggaaauauuaucuccauuuggaucucucacucaauacagcuugguaacaaaaaucagaucgagacguguaaccagagugucauuaccuacgaaaauaacacauggguuaaucaaacuuaugugaacaucagcaauaccaacuucgcugcaggccaguccguagugucugucaagauugccggaaauucgucacugugcccugugagcggaugggcgaucuacaguaaagacaacuccauaagaauuggcucuaagggugauguuuuugugaucagggagccauucauuagcuguuccccguuggaaugccggacauuuuucuuaacccagggggcucugcuaaaugacaaacauucaaacggaacuaucaaggaucgcagucccuaucgaacacucaugagcuguccuaucggcgaggucccaucucccuacaacucccguuuugaaucaguggccuggagcgcaagugccugccacgacggcauuaauuggcugaccauagggaucucuggaccugauaacggugcuguagcaguucuuaaguauaauggcauuaucacggacacuauaaaauccuggagaaacaauauucugaggacccaggagagcgagugugccugcgugaacgggucguguuucacaaucaugacugauggaccaucugacggccaggcuuccuacaagaucuuucggauugaaaaagguaagaucgucaaaucaguggagaugaaugcccccaacuaucauuacgaagagugcaguuguuacccugauagcuccgagauuaccugcgugugccgcgacaauuggcacgggucuaacagaccaugggucagcuucaaucaaaacuuggaauaucagauaggauacaucuguucaggcauuuuuggcgauaauccgaggccccaugacaagacagggaguugcggaccuguuuccagcaacggugcgaauggcgugaagggguucucuuuuaaauauggaaacggcguauggaucggucggaccaagucaaucaguagccgcaaaggguucgagaugauuugggauccaaacggcuggacgggaacugacaauaacuuuuccauaaagcaggacaucgugggcauuaaugaauggucuggguacucggggagcuucguccaacaccccgagcucacaggucuggauuguauccgaccuugcuucuggguggaacugauuagaggcaggccaaaagagaacaccaucuggacuuccgggucaaguauaucuuuuuguggaguuaauagcgacacagugggcugguccuggcccgauggugcagagcucccguucaccaucgacaaguga

SEQ ID NO: 147263 - RNA, 1410 nt, Artificial Sequence; identical to SEQ ID NO: 147249
  derived and/or modified sequence opt3 from neuraminidase__InfluenzaA__AHZ35994

SEQ ID NO: 147264 - RNA, 1410 nt, Artificial Sequence; identical to SEQ ID NO: 147249
  derived and/or modified sequence opt3 from neuraminidase__InfluenzaA__AHZ36005

SEQ ID NO: 147265 - RNA, 1410 nt, Artificial Sequence; identical to SEQ ID NO: 147249
  derived and/or modified sequence opt3 from neuraminidase__InfluenzaA__AHZ36016

SEQ ID NO: 147266 - RNA, 1410 nt, Artificial Sequence
  derived and/or modified sequence opt3 from neuraminidase__InfluenzaA__AHZ36027
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuaucuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcuucaauuggcuuacuaucgggauuucuggaccugauaacggugcuguagcaguucugaaguauaauggcaucauaacagacaccauuaaguccuggagaaacaauaucuugaggacgcaagagagcgagugugccugcgugaacgggucguguuuuacuaucaugaccgauggaccaucugacggccaggcuuccuacaaaauuuuccggaucgaaaaggguaaaauugucaagucaguggagaugaaugcccccaacuaucauuacgaagagugcaguuguuacccugauagcuccgagauaacaugcgugugccgcgacaauuggcacgggucuaacagaccaugggucagcuuuaaucagaaccucgaauaucagaucggauacauuuguucaggcaucuucggcgauaauccgaggcccaacgacaaaacugggaguugcggaccuguuuccagcaauggugcgaacggcgugaagggguuuucuuucaaguauggaaacggcguauggaucggucggaccaaaucaauuaguagccgcaagggguuugagaugauaugggauccaaauggcuggacaggaaccgacaacaauuucuccaucaaacaagacauuaucggcauuaacgaauggucuggguacucggggagcuucgugcagcaucccgagcugacgggucuggauuguauccgaccuugcuuuugggucgaacucauaagaggcaggccaaaggagaauacuaucuggacauccgggucaaguauuucuuucuguggagugaacagcgacaccguuggcugguccuggcccgauggugcagaguuaccguuuacuaucgacaaauga

SEQ ID NO: 147267 - RNA, 1410 nt, Artificial Sequence
  derived and/or modified sequence opt3 from neuraminidase__InfluenzaA__AHZ36050
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgccgaaaugauucaaguagcuccucucauugccuugacccuaacaaugaggaaggugggcacggaguuaagggcugggcuuucgaugacggcaacgauguguggauggggagaaccauuaaugagacaagcagguugggauaugagacuuuuaaagucaucgaagguuggucaaacccaaagaguaaacugcagauuaaucgucaggugauaguagaccggggcaaccgcuccggguacagcggaaucuucucuguugagggcaagucauguauuaauagaugcuuuuauguggaacuaaucaggggucggaaagaggaaaccgagguccucuggacaaguaacagcaucguggucuucugugggacuuccggcaccuacggaacaggcucuuggcccgauggggccgaccugaaucuuaugccuauuuga

SEQ ID NO: 147268 - RNA, 1410 nt, Artificial Sequence
  derived and/or modified sequence opt3 from neuraminidase__InfluenzaA__AHZ36062
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcgggugggcgauauacaguaaagacaacuccauuagaaucggcucuaagggugauguuuuugugauuagggagccauucaucagcuguuccccguuggggugccggaccuuuuucuuaacacagggagcucugcuaaaugacaaacauucaaacggcaccaucaaggaucgcagucccuaucgaacucucaugagcuguccuauuggcgaagucccaucucccuacaacucccguuuugagucaguggccuggagcgcaagugccugccacgacgggauaaauuggcugacaaucggaauuucugguccugauaacggcgcuguagcaguucuuaaguauaaugggaucauaaccgacacgauuaaauccuggagaaacaauauccugaggacucaggaaagcgagugugccugcgugaacggaucguguuucaccaucaugacagauggcccaucugacggucaggcuuccuacaagauuuuucggaucgagaaagggaagauugucaaaucaguggaaaugaaugcccccaacuaucauuacgaggaaugcaguuguuacccugauagcuccgagauaacuugcgugugccgcgacaauuggcacggaucuaacagaccaugggucagcuucaaucaaaacuuggaguaucagaucggcuacauuuguucaggcaucuuuggggauaauccgaggccccaugacaagaccggaaguugcgguccuguuuccagcaacggcgcgaauggggugaagggauucucuuuuaaauauggcaacgguguauggaucgggcggacaaagucaauuaguagccgcaaaggcuucgaaaugauaugggauccaaacggauggaccggcacggacaauaacuuuuccaucaagcaggacauuguggggaucaaugaguggucuggauacucggguagcuucguccaacaccccgaacucacuggccuggauuguauucgaccuugcuucuggguggagcugaucagagggaggccaaaagaaaacacaauauggaccuccggaucaaguaucucuuuuuguggcguuaauagcgacacuguggguugguccuggcccgauggggcagagcucccguucacaauugacaaguga

SEQ ID NO: 147269 - RNA, 1410 nt, Artificial Sequence; identical to SEQ ID NO: 147249
  derived and/or modified sequence opt3 from neuraminidase__InfluenzaA__AHZ36084

SEQ ID NO: 147270 - RNA, 1410 nt, Artificial Sequence
  derived and/or modified sequence opt3 from neuraminidase__InfluenzaA__AHZ36095
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuaucuacgaaaauaacacguggguuaaucagaccuaugugaacauaagcaauacaaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcuucaauuggcuuacuaucgggauuucuggaccugauaacggugcuguagcaguucugaaguauaauggcaucauaacagacaccauuaaguccuggagaaacaauaucuugaggacgcaagagagcgagugugccugcgugaacgggucguguuuuacuaucaugaccgauggaccaucugacggccaggcuuccuacaaaauuuuccggaucgaaaaggguaaaauugucaagucaguggagaugaaugcccccaacuaucauuacgaagagugcaguuguuacccugauagcuccgagauaacaugcgugugccgcgacaauuggcacgggucuaacagaccaugggucagcuuuaaucagaaccucgaauaucagaucggauacauuuguucaggcaucuucggcgauaauccgaggcccaacgacaaaacugggggaugcgguccuguuaguuccaauggcgcgaacggggugaagggauuuagcuucaaguauggcaacgguguauggaucgggcggaccaaaucuauuucaagucgcaagggcuuugagaugauaugggauccaaauggauggacaggcaccgacaacaauuucagcaucaaacaagacauuaucgggauuaacgaaugguccggauacucugguucguucgugcagcaucccgagcugacgggccuggauuguauccgaccuugcuuuugggucgaacucauaagagggaggccaaaggagaauacuaucuggacaagcggauccucaauuaguuucuguggcgugaacucugacaccguugguuggagcuggcccgauggggcagaguuaccguuuacuaucgacaaauga

SEQ ID NO: 147271 - RNA, 1410 nt, Artificial Sequence; identical to SEQ ID NO: 147249
  derived and/or modified sequence opt3 from neuraminidase__InfluenzaA__AHZ36106

SEQ ID NO: 147272 - RNA, 1410 nt, Artificial Sequence
  derived and/or modified sequence opt3 from neuraminidase__InfluenzaA__AHZ36117
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuaucuacgaaaauaacacguggguuaaucagaccuaugugaacauaagcaauacaaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguucuauaggcgaggucccuuccccauacaacucacguuuugaaagcguggccuggagugcaucugccugccacgacggcuucaauuggcuuacuaucgggauuuccggacccgauaacggugcuguagcaguucugaaguauaauggcaucauaacagacaccauuaagagcuggagaaacaauaucuugaggacgcaagagucggagugugccugcgugaacgggucuuguuuuacuaucaugaccgauggaccuuccgacggccaggcuucauacaaaauuuuccggaucgaaaaggguaaaauugucaagaguguggagaugaaugccccaaacuaucauuacgaagagugcagcuguuaccccgauuccucugagauaacaugcgugugccgcgacaauuggcacgggagcaacagaccuugggucucauuuaaucagaaccucgaauaucagaucggauacauuuguaguggcaucuucggcgauaauccaaggccgaacgacaaaacuggguccugcggacccguuagcucuaauggugcgaacggcgugaagggguuuucauucaaguauggaaacggcguauggaucggucggaccaaaaguauuagcucccgcaagggguuugagaugauaugggauccuaauggcuggacaggaaccgacaacaauuucucuaucaaacaagacauuaucggcauuaacgaauggucgggguacagcggauccuucgugcagcauccagagcugacgggucuggauuguauccgacccugcuuuugggucgaacucauaagaggcaggccuaaggagaauacuaucuggacaucagggaguucuauuagcuucuguggagugaacuccgacaccguuggcuggucauggccagauggugcagaguuacccuuuacuaucgacaaauga

SEQ ID NO: 147273 - RNA, 1410 nt, Artificial Sequence; identical to SEQ ID NO: 147249
  derived and/or modified sequence opt3 from neuraminidase__InfluenzaA__AHZ36128

SEQ ID NO: 147274 - RNA, 1410 nt, Artificial Sequence; identical to SEQ ID NO: 147249
  derived and/or modified sequence opt3 from neuraminidase__InfluenzaA__AHZ36139

SEQ ID NO: 147275 - RNA, 1410 nt, Artificial Sequence; identical to SEQ ID NO: 147267
  derived and/or modified sequence opt3 from neuraminidase__InfluenzaA__AHZ36150

SEQ ID NO: 147276 - RNA, 1410 nt, Artificial Sequence; identical to SEQ ID NO: 147249
  derived and/or modified sequence opt3 from neuraminidase__InfluenzaA__AHZ36161

SEQ ID NO: 147277 - RNA, 1410 nt, Artificial Sequence; identical to SEQ ID NO: 147249
  derived and/or modified sequence opt3 from neuraminidase__InfluenzaA__AHZ36172

SEQ ID NO: 147278 - RNA, 1410 nt, Artificial Sequence
  derived and/or modified sequence opt3 from neuraminidase__InfluenzaA__AHZ36183
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcggaugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugauaacggugcuguagcaguucuuaaguauaauggcaucauaaccgacacgauuaaauccuggagaaacaauauccugaggacucaggagagcgagugugccugcgugaacgggucguguuucaccaucaugacagauggaccaucugacggccaggcuuccuacaagauuuuucggaucgaaaaagguaagauugucaaaucaguggagaugaaugcccccaacuaucauuacgaagagugcaguuguuacccugauagcuccgagauaacuugcgugugccgcgacaauuggcacgggucuaacagaccaugggucagcuucaaucaaaacuuggaauaucagaucggauacauuuguucaggcauccucggcgauaauccgaggccccaugacaagaccgggaguugcggaccuguuuccagcaacggugcgaauggcgugaagggguuuucuuucaaauauggaaacggcguauggaucggucggacaaagucaauuaguagccgcaaaggguuugagaugauaugggauccaaacggcuggaccggaacggacaauaacuucuccaucaagcaggacauugugggcaucaaugaauggucuggguacucggggagcuuuguccaacaccccgagcugacuggucuggauuguauucgaccuugcuucuggguggaacucaucagaggcaggccaaaagagaacacaauauggaccuccgggucaaguaucucuuucuguggaguuaauagcgacacugugggcugguccuggcccgauggugcagaguuaccguuuacaauugacaaguga

SEQ ID NO: 147279 - RNA, 1410 nt, Artificial Sequence; identical to SEQ ID NO: 147248
  derived and/or modified sequence opt3 from neuraminidase__InfluenzaA__AHZ36194

SEQ ID NO: 147280 - RNA, 1410 nt, Artificial Sequence; identical to SEQ ID NO: 147267
  derived and/or modified sequence opt3 from neuraminidase__InfluenzaA__AHZ36206

SEQ ID NO: 147281 - RNA, 1410 nt, Artificial Sequence; identical to SEQ ID NO: 147249
  derived and/or modified sequence opt3 from neuraminidase__InfluenzaA__AHZ36218

SEQ ID NO: 147282 - RNA, 1410 nt, Artificial Sequence; identical to SEQ ID NO: 147267
  derived and/or modified sequence opt3 from neuraminidase__InfluenzaA__AHZ36229

SEQ ID NO: 147283 - RNA, 1410 nt, Artificial Sequence; identical to SEQ ID NO: 147249
  derived and/or modified sequence opt3 from neuraminidase__InfluenzaA__AHZ36241

SEQ ID NO: 147284 - RNA, 1410 nt, Artificial Sequence; identical to SEQ ID NO: 147249
  derived and/or modified sequence opt3 from neuraminidase__InfluenzaA__AHZ36252

SEQ ID NO: 147285 - RNA, 1410 nt, Artificial Sequence; identical to SEQ ID NO: 147249
  derived and/or modified sequence opt3 from neuraminidase__InfluenzaA__AHZ36263

SEQ ID NO: 147286 - RNA, 1410 nt, Artificial Sequence; identical to SEQ ID NO: 144938
  derived and/or modified sequence opt3 from neuraminidase__InfluenzaA__AHZ36274

SEQ ID NO: 147287 - RNA, 1410 nt, Artificial Sequence; identical to SEQ ID NO: 147249
  derived and/or modified sequence opt3 from neuraminidase__InfluenzaA__AHZ36286

SEQ ID NO: 147288 - RNA, 1410 nt, Artificial Sequence
  derived and/or modified sequence opt3 from neuraminidase__InfluenzaA__AHZ36297
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaggccugcugaguaccggaauuggaguaaaccacagugugacauaacaggguucgcacccuuuagcaaggauaacuccauucgcuuaucugccggaggugacaucuggguaacccgagagccuuaugugucgugcgauccagacaaauguuaccaauucgcgcugggccaggggacgacucuaaauaacguccauucaaauaacaccgugcgugauagaacacccuauaggacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggacggcucguggauuccguaguuucauggaguaaggagauucugcgcacgcaggaaagcgagugugugugcauaaacggcacuuguacagucgugaugaccgacggcucugcuuccgggaaagcagauacuaagauccuguuuauugaggaaggaaaaaucgugcauacaucaacccucagcgguggcgcccaacacgucgaggaaugcaguugcuauccaagauacccggggguuaggugugugugccgggacaacuggaagggaucuaaucgccccauaguagauauuaacaucaaggaccacuccaucgugagcucguacgucuguucuggcuuagugggugacacgccucggaaaaaugauuccucaaguagcucccauugccuggacccaaacaaugaggaagggggacacggcguuaagggcugggcuuucgaugacgggaacgauguguggaugggaagaaccauuaaugagacaucuaggcuugguuaugagacuuuuaaagucaucgaaggcuggagcaaccccaagucaaaauugcagauuaaucgacaggugauaguagaccguggggaucgcaguggauacuccggcaucuucagcguugaggguaagucuuguauuaacagaugcuuuuauguggaacugaucagggggcggaaagaggaaaccgagguccuauggacaucaaauaguaucguggucuucuguggcacuagcggaaccuacggcacaggguccuggccugacggagccgaucucaaccugaugccaauuuga

SEQ ID NO: 147289 - RNA, 1410 nt, Artificial Sequence
  derived and/or modified sequence opt3 from neuraminidase__InfluenzaA__AHZ36309
augaaccccaaucagaagaucauuaccauaggcagcgugugcaugacaaucgggauggccaaccugaugcuccaaauuggaaauaucauuuccaucuggauaucucacucaauccagcuuggugacaaaaaccagauugagacuuguaaucagagugucaucacguacgaaaacaauaccuggguuaaccaaacauaugugaauauuagcaacacuaauuucgcugcaggccaguccguagugucugucaagaucgccgggaacucgucacugugcccugugagcggaugggcgauauacaguaaagauaauuccauuagaaucggcucuaagggugacguuuuugugauuagggagccauucaucagcuguuccccguuggaaugccggaccuuuuucuuaacacagggggcucugcuaaacgauaaacauucaaauggaaccaucaaggaccgcagucccuaucgaacucucaugagcuguccuauuggcgaggucccaucucccuacaacucccguuuugaaucaguggccuggagcgcaagugccugccacgauggcauaaacuggcugacaaucgggauuucuggaccugacaauggugcuguagcaguucuuaaguauaacggcaucauaaccgauacgauuaaauccuggagaaauaacauccugaggacucaggagagcgagugugccugcgugaaugggucguguuucaccaucaugacagacggaccaucugauggccaagcuagcuacaagauuuuucggaucgaaaaagguaagauugucaaaucaguggagaugaacgcccccaauuaucauuacgaagagugcaguuguuacccugacagcuccgagauaacuugcgugugccgcgauaacuggcacgggucuaauagaccaugggucagcuucaaccagaauuuggaauaucagaucggauacauuuguucaggcaucuuuggcgacaacccgaggccccaugauaagaccgggaguugcggaccuguuuccagcaauggugcgaacggcgugaagggguucucuuuuaaauauggaaauggcguauggaucggucggacaaagucaauuaguagccgcaaaggguucgagaugauaugggacccaaacggcuggaccggaacggacaacaauuuuuccaucaagcaggauauugugggcaucaacgaauggucuggguacucgggauccuucguccaacaccccgagcucacuggucuggacuguauucgaccuugcuucuggguggaacugaucagaggcaggccaaaagagaauacaauauggaccuccgggucaaguaucucuuuuuguggaguuaacagcgauacugugggcugguccuggcccgacggugcagagcucccguucacaauugauaaguga

SEQ ID NO: 147290 - RNA, 1410 nt, Artificial Sequence; identical to SEQ ID NO: 147249
  derived and/or modified sequence opt3 from neuraminidase__InfluenzaA__AHZ36320

SEQ ID NO: 147291 - RNA, 1410 nt, Artificial Sequence; identical to SEQ ID NO: 147249
  derived and/or modified sequence opt3 from neuraminidase__InfluenzaA__AHZ36331

SEQ ID NO: 147292 - RNA, 1410 nt, Artificial Sequence; identical to SEQ ID NO: 144938
  derived and/or modified sequence opt3 from neuraminidase__InfluenzaA__AHZ36353

SEQ ID NO: 147293 - RNA, 1410 nt, Artificial Sequence
  derived and/or modified sequence opt3 from neuraminidase__InfluenzaA__AHZ36365
augaaccccaaucagaagaucauuaccauaggcagcgugugcaugacaaucgggauggccaaccugaugcuccaaauuggaaauaucauuuccaucuggauaucucacccuauccagcuugguaacaaaaaucagauugagacuuguaaccagucagucaucacguacgaaaauaacaccuggguuaaucaaacauaugugaacauuaguaauacuaacuucgcugcaggccagagcguaguguccgucaagaucgccggaaauucuucgcugugcccagugucagggugggcgauauacagcaaagacaacaguauuagaaucggcuccaagggugauguuuuugugauuagggagccguucaucucuuguagccccuuggaaugccggaccuuuuucuuaacacagggggcucugcuaaaugacaaacauuccaacggaaccaucaaggaucgcucaccuuaucgaacucucaugaguuguccaauuggcgagguccccagcccuuacaacucucguuuugaauccguggccuggucagcaagcgccugccacgacggcauaaauuggcugacaaucgggauuaguggaccagauaacggugcuguagcaguucuuaaguauaauggcaucauaaccgacacgauuaaaucuuggagaaacaauauccugaggacucaggaguccgagugugccugcgugaacgggagcuguuucaccaucaugacagauggacccucggacggccaggcuucuuacaagauuuuucggaucgaaaaagguaagauugucaaauccguggagaugaaugccccuaacuaucauuacgaagagugcucauguuacccagauaguagcgagauaacuugcgugugccgcgacaauuggcacggguccaacagaccgugggucucuuucaaucaaaacuuggaauaucagaucggauacauuuguagcggcaucuuuggcgauaaucccaggccucaugacaagaccgggucaugcggaccaguuaguuccaacggugcgaauggcgugaagggguucagcuuuaaauauggaaacggcguauggaucggucggacaaagucuauuucaagucgcaaaggguucgagaugauaugggaucccaacggcuggaccggaacggacaauaacuuuagcaucaagcaggacauugugggcaucaaugaaugguccggguacucuggaucguucguccaacacccugagcucacuggucuggauuguauucgaccaugcuucuggguggaacugaucagaggcaggcccaaagagaacacaauauggaccagcggguccucaaucaguuuuuguggaguuaauucugacacugugggcuggagcuggccggauggugcagagcucccuuucacaauugacaaguga

SEQ ID NO: 147294 - RNA, 1410 nt, Artificial Sequence; identical to SEQ ID NO: 144938
  derived and/or modified sequence opt3 from neuraminidase__InfluenzaA__AHZ36376

SEQ ID NO: 147295 - RNA, 1410 nt, Artificial Sequence; identical to SEQ ID NO: 144938
  derived and/or modified sequence opt3 from neuraminidase__InfluenzaA__AHZ36388

SEQ ID NO: 147296 - RNA, 1410 nt, Artificial Sequence; identical to SEQ ID NO: 144938
  derived and/or modified sequence opt3 from neuraminidase__InfluenzaA__AHZ36400

SEQ ID NO: 147297 - RNA, 1410 nt, Artificial Sequence; identical to SEQ ID NO: 144938
  derived and/or modified sequence opt3 from neuraminidase__InfluenzaA__AHZ36412

SEQ ID NO: 147298 - RNA, 1410 nt, Artificial Sequence; identical to SEQ ID NO: 144938
  derived and/or modified sequence opt3 from neuraminidase__InfluenzaA__AHZ36424

SEQ ID NO: 147299 - RNA, 1410 nt, Artificial Sequence; identical to SEQ ID NO: 144938
  derived and/or modified sequence opt3 from neuraminidase__InfluenzaA__AHZ36436

SEQ ID NO: 147300 - RNA, 1410 nt, Artificial Sequence
  derived and/or modified sequence opt3 from neuraminidase__InfluenzaA__AHZ36448
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaagccugcugaguacagaaauuggaguaaaccacagugugacauaacaggguucgcacccuuuagcaaggauaacuccauuagguuaucugccggaggugacaucuggguaacccgggagccuuaugugucgugcgauccagacaaguguuaccaauucgcgcugggccaggggacgacucuaaauaacguccauucaaauaacaccgugcgcgaucgaacacccuaucguacucuccugaugaaugaacuuggaguuccuuuucaccugggcaccaaacaggugugcauugcuuggagcaguuccucuugucaugacgguaaggccugguugcacgucugcaucacaggggaugacaaaaacgcaaccgccagcuucaucuacaauggaagacucguggauuccguaguuucauggaguaaggagauucugaggacgcaggaaagcgagugugugugcauaaacggcacuuguacagucgugaugaccgacggcucugcuuccgggaaagcagauacuaagauccuguuuauugaggaaggaaagaucgugcauacaucaacccucagcgguagugcccaacacgucgaggaaugcucuugcuauccacgguacccgggcguucgcugugugugcagagacaacuggaaaggguccaauaggcccauaguagauauuaacaucaaggaccacagcaucgugucgucuuacgucuguuccggauuagugggcgacacgccucggaaaaaugauucaaguagcuccucucauugccuggacccaaacaaugaggaaggugggcacggaguuaagggcugggcuuucgaugacggcaacgauguguggauggggcgcaccauuaaugagacaagccgacuuggauaugagacuuuuaaagucaucgaagguuggucaaaccccaagaguaaauugcagauuaauagacaggugauaguagacaggggcgaucgguccggguacagcggaaucuucucuguugagggcaagucauguauuaaccguugcuuuuauguggaacugauccgcgguagaaaggaggaaaccgagguccuauggacaaguaauagcaucguggucuucugugggacuuccggcaccuacggaacaggcucuuggccugacggggccgaucucaaccugaugccaauuuga

SEQ ID NO: 147301 - RNA, 1410 nt, Artificial Sequence; identical to SEQ ID NO: 144938
  derived and/or modified sequence opt3 from neuraminidase__InfluenzaA__AHZ36460

SEQ ID NO: 147302 - RNA, 1410 nt, Artificial Sequence; identical to SEQ ID NO: 144938
  derived and/or modified sequence opt3 from neuraminidase__InfluenzaA__AHZ36472

SEQ ID NO: 147303 - RNA, 1410 nt, Artificial Sequence; identical to SEQ ID NO: 144938
  derived and/or modified sequence opt3 from neuraminidase__InfluenzaA__AHZ36484

SEQ ID NO: 147304 - RNA, 1410 nt, Artificial Sequence; identical to SEQ ID NO: 144938
  derived and/or modified sequence opt3 from neuraminidase__InfluenzaA__AHZ36496

SEQ ID NO: 147305 - RNA, 1410 nt, Artificial Sequence; identical to SEQ ID NO: 144938
  derived and/or modified sequence opt3 from neuraminidase__InfluenzaA__AHZ36508

SEQ ID NO: 147306 - RNA, 1410 nt, Artificial Sequence; identical to SEQ ID NO: 144938
  derived and/or modified sequence opt3 from neuraminidase__InfluenzaA__AHZ36520

SEQ ID NO: 147307 - RNA, 1410 nt, Artificial Sequence
  derived and/or modified sequence opt3 from neuraminidase__InfluenzaA__AHZ36532
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggacauggaguaagccacagugugacauaaccggguucgcacccuuuagcaaagauaauuccauucgguuaucugccggaggugacaucuggguaacgcgcgagccuuaugugucgugcgauccagacaaguguuaccaauucgcgcugggccaggggacuacccuaaacaauguccauucaaacaauacagugcgagaucguacucccuauagaacccuccugaugaacgaacuuggaguuccuuuucaccugggcacaaaacaggugugcauugcuuggagcaguuccucuugucaugacgguaaggccugguugcacgucugcaucaccggggaugacaagaaugcaacggccagcuucaucuacaacggaaggcucguggauuccguaguuucauggaguaaagagauucugcggacucaggaaagcgagugugugugcauaaauggcacauguaccgucgugaugacugacggcucugcuuccgggaaggcagauacaaaaauccuguuuauugaggaaggaaagaucgugcauaccucaacgcucagcgguagugcccaacacgucgaggaaugcucuugcuauccacgcuacccgggcguuagaugugugugcagggacaacuggaagggguccaaccggcccauaguagauauuaauaucaaagaccacagcaucgugucgucuuacgucuguuccggauuagugggcgacaccccucgcaagaacgauucaaguagcuccucucauugccuggacccaaauaacgaggaaggugggcacggaguuaaaggcugggcuuucgaugacggcaaugauguguggauggggcgaacaauuaacgagacuagcagacuuggauaugagaccuuuaaggucaucgaagguuggucaaaucccaaaaguaaguugcagauuaacaggcaagugauaguagaccggggcgaucguuccggguacagcggaaucuucucuguugagggcaaaucauguauuaaucgcugcuuuuauguggaacugaucagagguaggaaggaggaaacagagguccuauggaccaguaacagcaucguggucuucugugggacuuccggcacauacggaaccggcucuuggccugacggggccgaucucaaucugaugccaauuuga

SEQ ID NO: 147308 - RNA, 1410 nt, Artificial Sequence; identical to SEQ ID NO: 144938
  derived and/or modified sequence opt3 from neuraminidase__InfluenzaA__AHZ36544

SEQ ID NO: 147309 - RNA, 1410 nt, Artificial Sequence; identical to SEQ ID NO: 144938
  derived and/or modified sequence opt3 from neuraminidase__InfluenzaA__AHZ36556

SEQ ID NO: 147310 - RNA, 1410 nt, Artificial Sequence; identical to SEQ ID NO: 144938
  derived and/or modified sequence opt3 from neuraminidase__InfluenzaA__AHZ36568

SEQ ID NO: 147311 - RNA, 1410 nt, Artificial Sequence; identical to SEQ ID NO: 144938
  derived and/or modified sequence opt3 from neuraminidase__InfluenzaA__AHZ36580

SEQ ID NO: 147312 - RNA, 1410 nt, Artificial Sequence; identical to SEQ ID NO: 144938
  derived and/or modified sequence opt3 from neuraminidase__InfluenzaA__AHZ36592

SEQ ID NO: 147313 - RNA, 1410 nt, Artificial Sequence; identical to SEQ ID NO: 144938
  derived and/or modified sequence opt3 from neuraminidase__InfluenzaA__AHZ36604

SEQ ID NO: 147314 - RNA, 1410 nt, Artificial Sequence; identical to SEQ ID NO: 144938
  derived and/or modified sequence opt3 from neuraminidase__InfluenzaA__AHZ36616

SEQ ID NO: 147315 - RNA, 1410 nt, Artificial Sequence
  derived and/or modified sequence opt3 from neuraminidase__InfluenzaA__AHZ36628
augaaccccaaucagaagaucauuaccauaggcagcgugucccugacaaucucuacuauuugcuucuuuaugcagaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaaccugcugaguauaggaauuggaguaagccacagugcgacauaacaggguucgcacccuuuagcaaagauaacuccauucgguuaucugccggaggugacaucuggguaacccgcgagccuuacgugucgugugauccagacaagugcuaucaauucgcgcugggccaggggacgacucuaaauaacguccauucaaauaacaccgugcgagaucguacacccuacagaacucuccugaugaaugaacuuggaguuccuuuucaccugggcaccaaacagguguguauugcuuggagcaguuccucuugccaugacgguaaggccugguugcacgucuguaucacaggggaugacaagaacgcaaccgccagcuucaucuauaauggaaggcucguggauuccguaguuucauggaguaaagagauucugcggacgcaggaaagcgagugcguguguauaaacggcacuugcacagucgugaugaccgacggcucugcuuccgggaaggcagauacuaaaauccuguuuauugaggaaggaaagaucgugcauacaucaacccucagcgguagugcccaacacgucgaggaaugcucuuguuacccacgcuauccgggcguuagaugcguguguagggacaacuggaagggguccaaucggcccauaguagauauuaacaucaaagaccacagcaucgugucgucuuacgucugcuccggauuagugggcgacacgccucgcaagaaugauucaaguagcuccucucauugucuggacccaaacaaugaggaaggugggcacggaguuaaaggcugggcuuucgaugacggcaacgauguguggauggggcgaaccauuaaugagacaagcagacuuggauacgagacuuuuaaggucaucgaagguuggucaaaccccaaaaguaaguugcagauuaauaggcaagugauaguagaccggggcgaucguuccggguauagcggaaucuucucuguugagggcaaaucaugcauuaaccgcuguuuuuacguggaacugaucagagguaggaaggaggaaaccgagguccuauggacaaguaauagcaucguggucuucugcgggacuuccggcaccuauggaacaggcucuuggccugacggggccgaucucaaccugaugccaauuuga

SEQ ID NO: 147316 - RNA, 1410 nt, Artificial Sequence
  derived and/or modified sequence opt3 from neuraminidase__InfluenzaA__AHZ36640
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcacgaucgaacacccuaucguacucuccugaugaaugaacuuggaguuccuuuucaucugggcaccaaacaggugugcauugcuuggagcaguuccucuugucacgacgguaaggccugguugcaugucugcaucacaggggaugacaagaacgcaaccgccagcuucaucuacaauggaagacucguggauuccguaguuucauggaguaaagagauucugaggacgcaggaaagcgagugugugugcauaaacggcacuuguacagucgugaugaccgacggcucugcuuccgggaaggcagauacuaaaauccuguuuauugaggaaggaaagaucgugcacacaucaacccucagcgguagugcccaacacgucgaggaaugcucuugcuauccacgguacccgggcguucgcugugugugcagagacaacuggaagggguccaauaggcccauaguagauauuaacaucaaagaccauagcaucgugucgucuuacgucuguuccggauuagugggcgacacgccucggaagaaugauucaaguagcuccucucacugccuggacccaaacaaugaggaaggugggcauggaguuaaaggcugggcuuucgaugacggcaacgauguguggauggggcgcaccauuaaugagacaagccgacuuggauaugagacuuuuaaggucaucgaagguuggucaaaccccaaaaguaaguugcagauuaauagacaggugauaguagacaggggcgaucgguccggguacagcggaaucuucucuguugagggcaaaucauguauuaaccguugcuuuuauguggaacugauccgcgguagaaaggaggaaaccgagguccuauggacaaguaauagcaucguggucuucugugggacuuccggcaccuacggaacaggcucuuggccugacggggccgaucucaaccugaugccaauuuga

SEQ ID NO: 147317 - RNA, 1410 nt, Artificial Sequence; identical to SEQ ID NO: 144938
  derived and/or modified sequence opt3 from neuraminidase__InfluenzaA__AHZ36652

SEQ ID NO: 147318 - RNA, 1410 nt, Artificial Sequence; identical to SEQ ID NO: 144162
  derived and/or modified sequence opt3 from neuraminidase__InfluenzaA__AHZ36664

SEQ ID NO: 147319 - RNA, 1410 nt, Artificial Sequence; identical to SEQ ID NO: 144162
  derived and/or modified sequence opt3 from neuraminidase__InfluenzaA__AHZ36676

SEQ ID NO: 147320 - RNA, 1410 nt, Artificial Sequence; identical to SEQ ID NO: 144162
  derived and/or modified sequence opt3 from neuraminidase__InfluenzaA__AHZ36688

SEQ ID NO: 147321 - RNA, 1398 nt, Artificial Sequence; identical to SEQ ID NO: 145470
  derived and/or modified sequence opt3 from neuraminidase__InfluenzaA__AHZ39689

SEQ ID NO: 147322 - RNA, 1398 nt, Artificial Sequence; identical to SEQ ID NO: 145470
  derived and/or modified sequence opt3 from neuraminidase__InfluenzaA__AHZ39713

SEQ ID NO: 147323 - RNA, 1398 nt, Artificial Sequence; identical to SEQ ID NO: 145470
  derived and/or modified sequence opt3 from neuraminidase__InfluenzaA__AHZ39725

SEQ ID NO: 147324 - RNA, 1398 nt, Artificial Sequence; identical to SEQ ID NO: 145470
  derived and/or modified sequence opt3 from neuraminidase__InfluenzaA__AHZ39737

SEQ ID NO: 147325 - RNA, 1398 nt, Artificial Sequence
  derived and/or modified sequence opt3 from neuraminidase__InfluenzaA__AHZ39749
augaaccccaaucagaagauccugugcauuagcgccaccgcuauaaucauuggcgcaaucgccgugcucauugggaucgcgaaccuuggacugaauauagguuugcacuuaaaaccuggcuguaacugcucccauucucaaccagagacaacuaauacgucacagaccaucauuaacaauuacuauaacgaaacaaauaucacuaacauucagauggaggaaagaaccaguaggaauuucaacaaucugacaaaggggcuauguaccaucaacagcuggcacauauacggaaaagacaaugcuguccggauuggcgaguccucugauguucucgugacucgcgaaccguauguaucgugcgaccccgaugagugucgauuuuacgcccugucacaggguacaaccauccgugggaagcauagcaacggaacgauucacgacagaagucaauauagggcacuuaucuccuggccucugucuagcccacccacuguguacaacucccgggucgagugcaucggcuggucaaguaccagcugucaugauggcaaaucucgcauguccauuugcauaucagggccuaauaacaaugccagcgcugugguuugguauaacagaaggccaguggcagaaaucaauacaugggcccggaacauuuugcgcacucaggagagugaaugugucugccacaauggagugugucccguaguuuucaccgacgguucugcuacaggcccugccgauacccgaaucuacuacuuuaaggaggggaagauacucaaaugggagucccugacgggaacugcgaagcacauugaagagugcagcugcuauggcgaaagaacagguaucaccuguacuugcagggacaacuggcaggggucgaaucggccagugauccagauugauccggucgcaaugacacauaccucucaauacaucuguucccccgugcugacggacaacccucguccaaaugaucccaacauuggaaaaugcaaugacccuuauccaggcaacaauaacaacggcgugaagggguucucauaccucgauggagccaauaccugguuaggucgcacaauaaguacugcuagcagauccggcuaugagaugcugaaaguccccaacgcccuuaccgacgacaggucuaagccgauccaggggcagacaauuguuuugaaugcagauuggagcggauacucaggcaguuuuauggacuauugggcugaaggugauuguuaccgggccugcuucuacguggagcugauccgagggcgcccuaaggaggacaaaguaugguggacuuccaacagcaucgugucuauguguucaaguaccgaauuucuaggccaguggaauuggcccgauggagcgaagauugaguauuuccucuga

SEQ ID NO: 147326 - RNA, 1398 nt, Artificial Sequence; identical to SEQ ID NO: 147325
  derived and/or modified sequence opt3 from neuraminidase__InfluenzaA__AHZ39761

SEQ ID NO: 147327 - RNA, 1398 nt, Artificial Sequence; identical to SEQ ID NO: 145470
  derived and/or modified sequence opt3 from neuraminidase__InfluenzaA__AHZ39773

SEQ ID NO: 147328 - RNA, 1398 nt, Artificial Sequence; identical to SEQ ID NO: 145470
  derived and/or modified sequence opt3 from neuraminidase__InfluenzaA__AHZ39785

SEQ ID NO: 147329 - RNA, 1410 nt, Artificial Sequence
  derived and/or modified sequence opt3 from neuraminidase__InfluenzaA__AHZ39797
augaaccccaaucagaagaucauuaccauaggcagcgugucccugacaaucucuacugucugcuucuuuaugcaaauugccauccucauuacgaccguuacacuucacuucaaacaguacgaguuuaacccuccaccgaauaaccaggugaugcugugugaacccacuaucauagagagaaauaucaccgaaauuguauauuugacaaacaccacuaucgagaaggaaauuugcccuaaaccagcugaguacaggaauuggucaaagccccagugugggaucacaggauucgcaccuuuuaguaaagacaacagcauacgguuauccgccgguggcgauauuugggugacccgcgagccauaugucucuugcgaccccgauaaguguuaccaauucgcgcuggggcagggaacgacucuaaauaacgugcauucgaauaacaccguucgagaccguacaccuuauagaacucuccugaugaaugaacuuggcgugccauuucaccuggguaccaagcaggucugcaucgcuuggucaagcaguuccugucaugaugggaaagccugguugcacgugugcauuacaggagacgauaagaacgcaaccgccucuuucaucuacaauggcaggcucguagacagcguuguguccuggucaaaagagauccugcggacgcaggaaagugagugugucugcauuaacggcacuuguacaguggugaugaccgaugggagcgcuucuggaaaguccgacacuaaaauacuguuuaucgaggaagguaagauuguccauacaucaacccucagcggcagugcacaacacguugaggaaugcucuugcuauccgcgcuaccccggggugagauguguaugcagggauaacuggaagggauccaaucggccuaucguggacauaaacauuaaagaucacagcaucgucucgucuuacguguguuccggcuuaguuggugacacgccacgcaagaaugacucaaguagcuccucucauugccuggaucccaacaaugaggaagggggacacggcgugaaaggcugggccuucgacgaugggaacgacgucuggaugggacgaaccaucaaugagacaagcagacuugguuaugagacuuuuaaggugauugaaggcuggucaaacccuaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccagauggagcugaccucaaccugaugcccaucuga

SEQ ID NO: 147330 - RNA, 1410 nt, Artificial Sequence
  derived and/or modified sequence opt3 from neuraminidase__InfluenzaA__AHZ39821
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacuccccgccgaaaugauucaaguagcuccucucauugccuugacccuaacaaugaggaaggugggcacggaguuaagggcugggcuuucgaugacggcaacgauguguggauggggagaacaaucaaugagacuagcagguugggauaugagaccuuuaaagucauugaagguuggucaaacccaaagaguaaacugcagaucaaucgucaggugauuguagaccggggcaaccgcuccggguacagcggaauauucucuguugagggcaagucauguaucaauagaugcuuuuauguggaacuaauuaggggucggaaagaggaaacagagguccucuggaccaguaacagcaucguggucuucugugggaccuccggcacauacggaaccggcucuuggcccgauggggccgaccugaaucuuaugccuacuuga

SEQ ID NO: 147331 - RNA, 1410 nt, Artificial Sequence; identical to SEQ ID NO: 145405
  derived and/or modified sequence opt3 from neuraminidase__InfluenzaA__AHZ39833

SEQ ID NO: 147332 - RNA, 1410 nt, Artificial Sequence; identical to SEQ ID NO: 144162
  derived and/or modified sequence opt3 from neuraminidase__InfluenzaA__AHZ39844

SEQ ID NO: 147333 - RNA, 1410 nt, Artificial Sequence
  derived and/or modified sequence opt3 from neuraminidase__InfluenzaA__AHZ39856
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgcgcuacgucuguucuggauuagugggcgacacgccucgaaagaaugauuccucaaguagcucccauugccuggacccaaacaaugaggaaggugggcacggaguuaaaggcugggcuuucgaugacggcaacgauguguggauggggagaaccauuaaugagacaucuaggcuuggauaugagacuuuuaaggucaucgaagguuggagcaaccccaaaucaaaguugccuauuaaucgucaggugauaguagaccggggcgaucgcaguggguacuccggaaucuucagcguugagggcaaaucuuguauuaacagaugcuuuuauguggaacugaucaggggucggaaggaggaaaccgagguccuauggacaucaaauaguaucguggucuucugugggacuagcggcaccuacggaacaggcuccuggccagacggggccgaucucaaccugaugcccauuuga

SEQ ID NO: 147334 - RNA, 1410 nt, Artificial Sequence; identical to SEQ ID NO: 144162
  derived and/or modified sequence opt3 from neuraminidase__InfluenzaA__AHZ39868

SEQ ID NO: 147335 - RNA, 1410 nt, Artificial Sequence
  derived and/or modified sequence opt3 from neuraminidase__InfluenzaA__AHZ39892
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucugggugacccgcgagccuuaugucucgugcgauccagacaaguguuaccaauucgcgcugggccaggggacgacucuaaauaacgugcauucaaauaacaccguucgagaucguacacccuauagaacucuccugaugaaugaacuuggagugccuuuucaccugggcaccaagcaggucugcauugcuuggagcaguuccucuugucaugacgguaaagccugguugcacgugugcaucacaggggaugacaagaacgcaaccgccagcuucaucuacaauggaaggcucguagauuccguugugucauggaguaaagagauucugcggacgcaggaaagcgagugugucugcauaaacggcacuuguacaguggugaugaccgacggcucugcuuccgggaaggcagauacuaaaauccuguuuauugaggaaggaaagaucguccauacaucaacccucagcgguagugcccaacacguugaggaaugcucuugcuauccacgcuacccgggcgugagauguguaugcagggacaacuggaagggguccaaucggcccauaguggauauuaacaucaaagaccacagcaucgucucgcgcuacguguguucuggauuaguuggcgacacgccucgaaagaaugauuccucaaguagcucccauugccuggacccaaacaaugaggaaggugggcacggagugaaaggcugggcuuucgaugacggcaacgaugucuggauggggagaaccauuaaugagacaucuaggcuuggauaugagacuuuuaaggugaucgaagguuggagcaaccccaaaucaaaguugcagauuaaucggcagguaauaguugaccguggcgaucgcaguggguacuccggaaucuucagcguggagggcaaaucuuguauuaacagaugcuuuuaugucgaacugaucaggggucggaaggaggaaaccgaggugcuauggacaucaaauaguaucgucguguucugugggacuagcggcaccuacggaacaggcuccuggccugacggggccgaucucaaccugaugccaauuuga

SEQ ID NO: 147336 - RNA, 1410 nt, Artificial Sequence; identical to SEQ ID NO: 145370
  derived and/or modified sequence opt3 from neuraminidase__InfluenzaA__AHZ39904

SEQ ID NO: 147337 - RNA, 1410 nt, Artificial Sequence; identical to SEQ ID NO: 145370
  derived and/or modified sequence opt3 from neuraminidase__InfluenzaA__AHZ39916

SEQ ID NO: 147338 - RNA, 1410 nt, Artificial Sequence; identical to SEQ ID NO: 144162
  derived and/or modified sequence opt3 from neuraminidase__InfluenzaA__AHZ39928

SEQ ID NO: 147339 - RNA, 1410 nt, Artificial Sequence
  derived and/or modified sequence opt3 from neuraminidase__InfluenzaA__AHZ39940
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcaucgcuuggagcaguuccucuugucaugaugggaaggccugguugcacgucugcauuacaggagacgauaagaacgcaaccgccagcuucaucuacaauggcaggcucguggacuccguaguuucauggaguaaagagauccugcggacgcaggaaagcgagugugugugcauuaacggcacuuguacagucgugaugaccgaugggucugcuuccggaaaggcagacacuaaaauacuguuuaucgaggaagguaagauugugcauacaucaacccucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacacgccucgcaagaccgacucaaguagcuccucucauugccuggauccaaauaacgaggaagggggacacggcguuaaaggcugggcuuucgacgaugggaaugacguguggaugggacgaacaaucaacgagacuagcagacuugguuaugagaccuuuaaggucauugaaggcuggucaaaucccaaaaguaaguugcagaucaacaggcaagugauuguagaucguggggaccgguccggauacagcggcauauucucuguugaggguaaaucauguaucaaucgcugcuuuuauguggaacugauuagagggaggaaggaggaaacagagguccuauggaccaguaacagcaucguggucuucuguggcacuuccggaacauacggcaccgggucuuggccugauggagccgaccucaaucugaugccaaucuga

SEQ ID NO: 147340 - RNA, 1410 nt, Artificial Sequence; identical to SEQ ID NO: 144162
  derived and/or modified sequence opt3 from neuraminidase__InfluenzaA__AHZ39952

SEQ ID NO: 147341 - RNA, 1410 nt, Artificial Sequence; identical to SEQ ID NO: 144162
  derived and/or modified sequence opt3 from neuraminidase__InfluenzaA__AHZ39976

SEQ ID NO: 147342 - RNA, 1410 nt, Artificial Sequence
  derived and/or modified sequence opt3 from neuraminidase__InfluenzaA__AHZ39988
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacaugcauucaaauaacaccguccgagaccguacacccuauagaacucuccugaugaaugaacuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagagauucugcggacgcaggaaagcgaguguguuugcauaaacggcacuuguacaguggucaugaccgaugggucugcuuccggaaaggcagacacuaaaauccuguuuauugaggaagguaagaucgugcauacaucaacccucagcggcaguacgcaacacguggaggaaugcucuugcuauccacgcuacccgggggucagauguguuugcagggauaacuggaagggauccaaucggcccauaguggacauuaacaucaaagaucacagcaucguaucgucuuacguguguuccggcuuagucggugacaccccucgcaagaaugacucaaguagcuccucucauugccuggauccaaacaaugaggaagggggacacggcgugaaaggcugggccuucgacgaugggaacgacguuuggaugggacgaacaauuaaugagacuagcagacuugguuaugagaccuuuaaggugaucgaaggcuggucaaaccccaaaaguaaguugcagauuaauaggcaggucauaguggaucguggggaccgguccggauacagcggcaucuucucuguagaggguaaaucauguauuaaccgcugcuuuuauguugaacugaucagagggaggaaggaggaaacagaggugcuauggaccaguaauagcaucgucguguucuguggcacuuccggaacauacggcaccgggucuuggccugauggagcugaccucaaccugaugccaauuuga

SEQ ID NO: 147343 - RNA, 1410 nt, Artificial Sequence; identical to SEQ ID NO: 144162
  derived and/or modified sequence opt3 from neuraminidase__InfluenzaA__AHZ40000

SEQ ID NO: 147344 - RNA, 1410 nt, Artificial Sequence; identical to SEQ ID NO: 144162
  derived and/or modified sequence opt3 from neuraminidase__InfluenzaA__AHZ40012

SEQ ID NO: 147345 - RNA, 1410 nt, Artificial Sequence
  derived and/or modified sequence opt3 from neuraminidase__InfluenzaA__AHZ40024
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuuugagacuuucaaggucaucgaaggcuggucaaaccccaaaaguaaguugcagauuaauaggcaagugauaguagaucguggggaccgguccggauauagcggcaucuuuucuguugaggguaaaucauguauuaaccgcugcuucuacguggaacugaucagagggaggaaggaggaaaccgagguccuauggacaaguaauagcaucguggucuucuguggcacuuccggaaccuauggcacagggucuuggccugauggagccgaccucaaccugaugccaauuuga

SEQ ID NO: 147346 - RNA, 1410 nt, Artificial Sequence; identical to SEQ ID NO: 144162
  derived and/or modified sequence opt3 from neuraminidase__InfluenzaA__AHZ40036

SEQ ID NO: 147347 - RNA, 1410 nt, Artificial Sequence; identical to SEQ ID NO: 145373
  derived and/or modified sequence opt3 from neuraminidase__InfluenzaA__AHZ40048

SEQ ID NO: 147348 - RNA, 1410 nt, Artificial Sequence; identical to SEQ ID NO: 144162
  derived and/or modified sequence opt3 from neuraminidase__InfluenzaA__AHZ40063

SEQ ID NO: 147349 - RNA, 1410 nt, Artificial Sequence
  derived and/or modified sequence opt3 from neuraminidase__InfluenzaA__AHZ40075
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaacaguaaauccaaguugcagaucaauaggcagguaauuguugaucguggggaccggagcggauacucuggcauauucucaguggaggguaaaaguuguaucaaccgcugcuuuuaugucgaacugauuagagggaggaaggaggaaaccgaggugcuauggacaagcaauuccaucgucguguucuguggcacuucuggaaccuacggcacagggucguggcccgauggagccgaccucaaccugaugccuaucuga

SEQ ID NO: 147350 - RNA, 1410 nt, Artificial Sequence; identical to SEQ ID NO: 144162
  derived and/or modified sequence opt3 from neuraminidase__InfluenzaA__AHZ40087

SEQ ID NO: 147351 - RNA, 1410 nt, Artificial Sequence; identical to SEQ ID NO: 145373
  derived and/or modified sequence opt3 from neuraminidase__InfluenzaA__AHZ40099

SEQ ID NO: 147352 - RNA, 1410 nt, Artificial Sequence
  derived and/or modified sequence opt3 from neuraminidase__InfluenzaA__AHZ40111
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccagacaaguguuaccaauucgcgcuaggccaggggacgacucucaauaacguccauucgaauaacaccgugcgagaucguacacccuauagaacucugcuuaugaaugaacugggaguuccuuuucacuugggcaccaaacaggugugcauugcuuggucaagcaguuccugucaugacgguaaggccuggcuccacgucugcaucacaggggaugacaagaacgcaaccgccucuuucaucuacaauggaaggcugguggauagcguaguuuccuggucaaaagacauucugcggacgcaggagagugaaugugugugcauaaacggcacuugugcugucgugaugacagauggcagcgcaucugggaaggccgacaccaaaauccucuuuauugaggagggaaagaucgugcauacuuccacauuaucagguagcgcucaacacgucgaagagugcaguugcuauccacgcuacccgggcguuagaugugugugcagggauaacuggaaggggucuaaucggcccauaguagacauuaacaucaaagaccacuccaucgugagcucguacgucuguucuggacuggugggcgauaccccucgcaagaaugacuccucaaguagcggucauugccuugauccaaacaaugaagaagggggacacggcguuaaaggcugggccuucgacgaugggaacgacguguggaugggacgaacgauuaaugagaccuccagauuggguuaugagacauuuaaggucaucgagggcuggucuaaccccaaaagcaagcugcagauuaauaggcaagugauaguagaucgggggaaccguucaggauacaguggcaucuucuccguugaagguaaaaauuguauuaaccgcugcuuuuauguggagcuaaucagagggaggaaggaagagacugaaguccucuggaccagcaauucuaucguggucuucuguggcacaucaggaacuuacggcaccgggaguuggccugacggagcggaucugaaccuuaugccaauuuga

SEQ ID NO: 147353 - RNA, 1410 nt, Artificial Sequence
  derived and/or modified sequence opt3 from neuraminidase__InfluenzaA__AHZ40123
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaccgagagaaauaucacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauacccgcacgcucucaggcagcgcccaacacgucgaggaaugcaguugcuauccaagauacccggggguuaggugugugugccgggauaacuggaagggaucuaaucgccccaucguagacauaaacauuaaagaucacuccaucgugagcucguacgucuguucuggcuuagugggugacaccccucgaaagaaugacuccucaaguagcucccauugccuggauccaaacaaugaggaagggggacacggcguuaaaggcugggcuuucgacgaugggaacgacguguggaugggaagaacaaucaaugagacuucuaggcuugguuaugagaccuuuaaggucauugaaggcuggagcaaccccaaaucaaaguugcagaucaaucggcaagugauuguagaucguggggaccgcaguggauacuccggcauauucagcguugaggguaaaucuuguaucaacagaugcuuuuauguggaacugauuagggggcggaaggaggaaacagagguccuauggacuucaaauaguaucguggucuucuguggcaccagcggaacauacggcaccggguccuggccugauggagccgaccucaaccugaugccaaucuga

SEQ ID NO: 147354 - RNA, 1410 nt, Artificial Sequence; identical to SEQ ID NO: 144162
  derived and/or modified sequence opt3 from neuraminidase__InfluenzaA__AHZ40133

SEQ ID NO: 147355 - RNA, 1410 nt, Artificial Sequence; identical to SEQ ID NO: 145380
  derived and/or modified sequence opt3 from neuraminidase__InfluenzaA__AHZ40145

SEQ ID NO: 147356 - RNA, 1410 nt, Artificial Sequence
  derived and/or modified sequence opt3 from neuraminidase__InfluenzaA__AHZ40157
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaauuaugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcauggcuuggagcaguuccucuugucaugacgguaaggccuggcugcacgucugcaucacaggggaugacaagaacgcaaccgccagcuucauuuacaauggaaaacugguggauuccguaguuucauggaguaaggagauccucaggacgcaggaaagcgagugugugugcaucaacggcacuuguacagucgugaugaccgacggcucugcuuccgggaaagcagauacuaagauuuuauuuauagaggaaggaaagaucgugcauacaucaacccugagcgguagugcccaacacgucgaggaaugcucuugcuauccucgguacccaggcguucgcugugugugcagagacaacuggaaaggguccaauaggccgauuguagauaucaacauaaaggaccacagcauugugucgucuuacgucuguuccggacuugugggcgacacgccccggaaaaccgauucaaguagcuccucucauugcuuggacccuaauaacgaggaaggugggcacggaguuaagggcugggcuuucgaugacggcaaugauguguggauggggcgcacaaucaacgagacuagccgacugggauaugagaccuuuaaagucaucgaagguuggucaaauccaaagaguaaacuacagauuaacagacaggugaucguagacaggggcgaucgguccggguacagcggaauuuucucuguugagggcaagucauguauaaaucguugcuuuuauguggaacucauccgcgguagaaaggaggaaacagccguccuguggaccaguaacagcauuguggucuucugugggacuuccggcacauacggaaccggcucuuggcccgacggggcggaucuuaaucugaugccuaucuga

SEQ ID NO: 147357 - RNA, 1410 nt, Artificial Sequence
  derived and/or modified sequence opt3 from neuraminidase__InfluenzaA__AHZ40169
augaaccccaaucagaagaucauuaccauaggcagcgugugcaugacaaucgggauggccaaccugauucuccaaaucggaaauauuaucuccauauggaucucucacucaauucagcuugagaaccagagucagaucgaaacuuguaaucaaagcgucauuacguacgagaacaauaccuggguuaaccagacauaugugaauaucuccaacacuaauuucgcugcaggucagucuguagugucggucaaacuggccggcaacagcagcuugugcccugugagugggugggcgauauacuccaaggacaauucuguuagaauuggaagcaaaggcgauguguuugucaucagggaaccauucauuuccuguucaccguuagagugccggaccuuuuuccugacacagggugcucuacucaacgacaagcauaguaaugggaccaucaaagaucgcagccccuaucgaacucugaugucuuguccuaucggagaagugccaucccccuacaacucacguuuugagagcguagccuggagugcaucugccugccacgacggcauuaacuggcuuacaauaggcaucuccgggccugauagcggagcuguugcagugcugaaguauaaugguauuaucaccgacacgauaaagucguggagaaacaauauuuugaggacucaagagucugaaugugccugcgucaacggcuccuguuucaccaucaugacagaugggccaucagacggacaggcuaguuacaaaaucuuucggauugagaagggcaaaaucgugaagucaguggaaaugaaugcccccaacuaucauuacgaggagugcuccuguuacccugauucuagcgaaauuacuugcgucugccgcgacaauuggcacgguucaaacagaccauggguuaguuucaaucagaaccucgaguaucagauaggguacaucuguuccggaauuuuuggcgauaauccgaggcccaacgacaaaaccggcagcugcgggccugugucuucaaauggagcgaacgguguaaagggcuucaguuuuaaguaugggaauggaguguggaucggccggacaaaaagcaucuccucucgcaaggguuucgaaaugauuugggauccaaacggguggaccggcacggacaacaauuuuucgauaaaacaagacaucgucggaauuaacgaguggagcggcuacuccgggucauucgugcagcaucccgaacugacuggacuggauuguauccgaccuugcuucuggguugagcucauuagagguaggccaaaggagaauacaaucuggaccaguggcucuagcauauccuuuuguggggugaacucagacacugucggauggagcuggcccgauggcgcagaauuaccguucacaaucgacaaauga

SEQ ID NO: 147358 - RNA, 1410 nt, Artificial Sequence
  derived and/or modified sequence opt3 from neuraminidase__InfluenzaA__AHZ40180
augaaccccaaucagaagaucauuaccauaggcagcgugucccugacaaucucuacuauuugcuucuuuaugcagaucacgauucucaucaccacagucacucuucacuucaaacaguacgaguuuaacucaccuccaaauaaccagguuaugcugugugaaccgaccauaaucgagagaaauauuacagaaaucguguauuugaccaacacuacaauugagaaggaaaucugccccaaaccugccgaguacaggaauuggaguaagccacagugugggauaaccggauucgcucccuuuagcaaagacaacuccauucgguuaucugcagggggcgauaucuggguaacgcgcgagccuuaugugucgugcgacccagauaaguguuaccaauucgcccuggggcagggaacuacccuaaauaacguccauucaaauaacacagugcgagaccguacucccuauagaacccuccugaugaaugaacuuggcguuccuuuucaccuggguacaaaacaggugugcauugcguggagcaguuccucuugucaugaugggaaggcuugguugcacgucugcaucaccggagacgauaagaacgccacggcaaguuucaucuacaauggcaggcucguggacuccguaguuucauggaguaaagagauucugcggacucaggaaagcgagugugugugcauaaacggcacauguaccgucgugaugacugaugggucugccuccggaaaggcugacacaaaaauccuguuuauugaggaagguaagaucgugcauaccucaacgcucagcggcagugcacaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacaccccucgcaagaaugacucaaguagcuccucucauugccuggauccaaacaaugaggaagggggacacggcguuaaaggcugggccuucgacgaugggaacgacguguggaugggacgaacaauuaaugagacuagcagacuugguuaugagaccuuuaaggucaucgaaggcuggucaaaccccaaaaguaaguugcagauuaauaggcaagugauaguagaucggggugaccguuccggauacagcggcaucuucucuguugaggguaaaucauguauuaaccgcugcuuuuauguggaacugaucagagggaggaaggaggaaacagagguccuauggacuagcaauagcaucguggucuucuguggcaccuccggaacauacggcaccgggucuuggccugauggagcugaccucaaccugaugccaauuuga

SEQ ID NO: 147359 - RNA, 1410 nt, Artificial Sequence; identical to SEQ ID NO: 145026
  derived and/or modified sequence opt3 from neuraminidase__InfluenzaA__AHZ40192

SEQ ID NO: 147360 - RNA, 1410 nt, Artificial Sequence; identical to SEQ ID NO: 144162
  derived and/or modified sequence opt3 from neuraminidase__InfluenzaA__AHZ40204

SEQ ID NO: 147361 - RNA, 1410 nt, Artificial Sequence; identical to SEQ ID NO: 144162
  derived and/or modified sequence opt3 from neuraminidase__InfluenzaA__AHZ40216

SEQ ID NO: 147362 - RNA, 1410 nt, Artificial Sequence; identical to SEQ ID NO: 145391
  derived and/or modified sequence opt3 from neuraminidase__InfluenzaA__AHZ40228

SEQ ID NO: 147363 - RNA, 1410 nt, Artificial Sequence
  derived and/or modified sequence opt3 from neuraminidase__InfluenzaA__AHZ40240
augaaccccaaucagaagaucauuaccauaggcagcgugucccugacaaucucuacuauuugcuuccucaugcaaaucgccauucuuaucacgaccgcuacacugcacuuuaaacaguacgaguucaacucaccuccaaauaaccaggucauguugugugaaccgacuauaaucgagagaaauauuaccgaaaucguuuauuuaacaaacaccacuauugagaaggaaaucugccccaaaccugcagaguacaggaauuggaguaagccacagugugggauaacaggauuugcccccuucagcaaagacaacuccauucggcugucugcggguggcgauaucugggugacccgcgagccuuauguaucgugcgacccagauaaguguuaccaauuugcucuagggcagggaacgacucucaauaacgugcauucaaauaacaccguccgagaccguacacccuauagaacucugcuuaugaaugaacugggcgugccuuuccacuuggguaccaagcagguuugcauugccuggagcaguuccucuugucaugaugggaaagcauggcuccacgugugcaucacaggagacgauaagaacgccaccgcuagcuuuaucuacaauggcaggcuggucgacuccgugguaucauggaguaaagagauucugcggacgcaggaaagcgaguguguuugcauaaacggcacuuguacaguggucaugaccgaugggucugcauccggaaaggccgacacuaaaauccucuucauugaggaagguaagaucgugcauacaucaaccuuaagcggcagugcucaacacguggaggaaugcucuugcuauccacgcuacccgggggucagauguguuugcagggauaacuggaagggauccaaucggcccauaguggacauuaacaucaaagaucgcagcaucguaucgucuuacguguguuccggccuggucggugacacgccucgaaagaaugacucaaguagcuccucucacugccuugauccaaacaaugaggaagggggacauggcgugaaaggcugggccuuugacgaugggaacgacguuuggaugggaagaaccauuaaugagacaagcagguuggguuaugagacuuucaaggugaucgaaggcuggucaaaccccaaaaguaagcugcagauuaaucggcaggucauaguggaucguggggaccgcuccggauacagcggcaucuuuucuguagaggguaaaucauguauuaacagaugcuucuauguugaacuaaucagggggcggaaggaggaaaccgaggugcucuggacaaguaauagcaucgucguguuuuguggcacuuccggaaccuacggcacagggucuuggccugauggagcggaccugaaccuuaugccaauuuga

SEQ ID NO: 147364 - RNA, 1410 nt, Artificial Sequence
  derived and/or modified sequence opt3 from neuraminidase__InfluenzaA__AHZ40252
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagaggacaagaacgcaaccgccagcuucaucuacaauggcaggcucguggauuccauuguaucauggaguaaagaaauacugcggacgcaggagagcgaguguguuugcaucaacggcacuuguacaguggucaugaccgacgggucugcuuccggaaaggcagauacuaaaauucuguuuaucgaagaggguaagauagugcauacaucaacccucagcggcagugcccaacacguggaagagugcucuugcuauccacgcuacccgggggucagauguguuugcagggacaacuggaagggauccaaucggcccauuguggauaucaacaucaaagaccacagcauuguaucgucuuacguguguuccggcuuagucggugauacgccucgcaagaaugacucaaguagcuccucucauugccuggacccaaacaaugaagaagggggacacggcgugaaaggcugggcuuucgaugacgggaacgauguuuggaugggacgaaccaucaaugagacaagcagacuugguuaugagacuuuuaaggugauugagggcuggucaaaccccaaaaguaaguugcagauaaauaggcaggucaucguggaccguggggaucgguccggauacagcggcauuuucucuguagaagguaaaucauguaucaaccgcugcuuuuauguugagcugaucagagggaggaaggaagagaccgaggugcuauggacaaguaauagcauugucguguucuguggcacuuccggaaccuacggcacagggucuuggccugacggagccgaucucaaccugaugccaauauga

SEQ ID NO: 147365 - RNA, 1410 nt, Artificial Sequence; identical to SEQ ID NO: 147110
  derived and/or modified sequence opt3 from neuraminidase__InfluenzaA__AHZ40264

SEQ ID NO: 147366 - RNA, 1410 nt, Artificial Sequence; identical to SEQ ID NO: 144162
  derived and/or modified sequence opt3 from neuraminidase__InfluenzaA__AHZ40276

SEQ ID NO: 147367 - RNA, 1410 nt, Artificial Sequence
  derived and/or modified sequence opt3 from neuraminidase__InfluenzaA__AHZ40288
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaauuucauggaguaaagacauacugcggacgcaggagagcgaauguguuugcaucaacggcacuugugcuguggucaugacagauggcucugcauccgggaaggccgacaccaaaauucucuuuaucgaggagggaaagauagugcauacuucaacauuaagcgguagugcucaacacguggaagagugcucuugcuauccucgcuacccaggcgucagauguguuugcagggauaacuggaagggguccaaucggccgauuguggacaucaacaucaaagaccacagcauuguaucgucuuacguguguuccggacuggucggcgauacgccccgcaagaaugacucaaguagcuccggucauugccuugauccuaacaaugaagaagggggacacggcgugaaaggcugggccuucgacgaugggaacgacguuuggaugggacgaaccaucaaugagaccucuagauuggguuaugagacauuuaaggugauugagggcuggagcaacccaaaaucaaagcugcagauaaauaggcaggucaucguggaucgggggaaccguaguggauacuccggcauuuucagcguagaagguaaaaauuguaucaaccgcugcuuuuauguugagcuaaucagagggaggaaggaagagacugaagugcucuggaccucuaauucaauugucguguucuguggcacaaguggaacuuacggcaccgggagcuggcccgacggagcggaucugaaccuuaugccuauauga

SEQ ID NO: 147368 - RNA, 1410 nt, Artificial Sequence
  derived and/or modified sequence opt3 from neuraminidase__InfluenzaA__AHZ40312
augaaccccaaucagaagaucauuaccauaggcagcgugucccugacaaucucuacuauuugcuucuuuaugcaaaucgccauucucaucacgaccgucacacuucacuucaaacaguacgaguuuaacuauccuccaaauaaccagguuaugcugugugaaccgacuauaaucgagagaaauauuaccgaaaucguguacuugacaaacaccacuauugagaaggaaaucugccccaaaccugcugaguauaggaauuggucaaagccacagugugggauaacaggauucgcacccuuuaguaaagacaacagcauucgguuauccgccgguggcgauaucuggguaacccgcgagccuuacgugucuugcgacccagauaaguguuaucaauucgcgcuggggcagggaacgacucuaaauaacguccauucgaauaacaccgugcgagaccguacacccuacagaacucuccugaugaaugaacuuggcguuccuuuucaccuggguaccaaacaggugugcauugcuuggucaagcaguuccugucaugaugggaaggccugguugcacgucugcaucacaggagacgauaagaacgcaaccgccucuuucaucuauaauggcaggcucguggacagcguaguuuccuggucaaaagagauucugcggacgcaggaaagugagugugugugcauaaacggcacuuguacagucgugaugaccgaugggagcgcuucuggaaaggcagacacuaaaauccuguuuauugaggaagguaagaucgugcauacauccacccucucaggcagcgcccaacacgucgaggaaugcaguugcuacccacgcuacccggggguuagaugugugugcagggauaacuggaagggaucuaaucggcccauaguagacauuaacaucaaagaucacuccguggucagcucguauguguguucuggcuuaguuggugacacgccucgcaagaaugacuccucaaguagcucccauugccuggauccaaacaaugaggaagggggacacggcgugaaaggcugggcuuucgacgaugggaacgacgucuggaugggacgaaccaucaaugagacaucuagacuugguuacgagacuuuuaaggugauugaaggcuggagcaaccccaaaucaaaguugcagaucaauaggcagguaauuguugaucguggggaccggaguggauauuccggcauauucagcguggaggguaaaucuuguaucaaccgcugcuuuuacgucgaacugauuagagggaggaaggaggaaaccgaggugcuauggacaucaaauaguaucgucguguucuguggcacuagcggaaccuauggcacaggguccuggccugauggagccgaccucaaccugaugccaaucuga

SEQ ID NO: 147369 - RNA, 1410 nt, Artificial Sequence; identical to SEQ ID NO: 144162
  derived and/or modified sequence opt3 from neuraminidase__InfluenzaA__AHZ40324

SEQ ID NO: 147370 - RNA, 1410 nt, Artificial Sequence; identical to SEQ ID NO: 144162
  derived and/or modified sequence opt3 from neuraminidase__InfluenzaA__AHZ40336

SEQ ID NO: 147371 - RNA, 1410 nt, Artificial Sequence; identical to SEQ ID NO: 147345
  derived and/or modified sequence opt3 from neuraminidase__InfluenzaA__AHZ40348

SEQ ID NO: 147372 - RNA, 1410 nt, Artificial Sequence; identical to SEQ ID NO: 145370
  derived and/or modified sequence opt3 from neuraminidase__InfluenzaA__AHZ40360

SEQ ID NO: 147373 - RNA, 1410 nt, Artificial Sequence
  derived and/or modified sequence opt3 from neuraminidase__InfluenzaA__AHZ40372
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaaggggaccacggaguuaaaggcugggcuuucgaugacggcaacgauguguggauggggcgaaccauuaaugagacaagcagacuuggauaugagacuuuuaaggucaucgaagguuggucaaaccccaaaaguaaguugcagauuaauaggcaagugauaguagaccggggcgaucguuccggguacagcggaaucuucucuguugagggcaaaucauguauuaaccgcugcuuuuauguggaacugaucagagguaggaaggaggaaaccgagguccuauggacaaguaauagcaucguggucuucugugggacuuccggcaccuacggaacaggcucuuggccugacggggccgaucucaaccugaugccaauuuga

SEQ ID NO: 147374 - RNA, 1410 nt, Artificial Sequence; identical to SEQ ID NO: 145026
  derived and/or modified sequence opt3 from neuraminidase__InfluenzaA__AHZ40384

SEQ ID NO: 147375 - RNA, 1410 nt, Artificial Sequence; identical to SEQ ID NO: 144162
  derived and/or modified sequence opt3 from neuraminidase__InfluenzaA__AHZ40396

SEQ ID NO: 147376 - RNA, 1410 nt, Artificial Sequence; identical to SEQ ID NO: 144162
  derived and/or modified sequence opt3 from neuraminidase__InfluenzaA__AHZ40408

SEQ ID NO: 147377 - RNA, 1410 nt, Artificial Sequence; identical to SEQ ID NO: 144162
  derived and/or modified sequence opt3 from neuraminidase__InfluenzaA__AHZ40420

SEQ ID NO: 147378 - RNA, 1410 nt, Artificial Sequence
  derived and/or modified sequence opt3 from neuraminidase__InfluenzaA__AHZ40432
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaauugauaucaacaucaaagaccacagcauuguaucgcgcuacguguguucuggauuagucggcgacacgccucgaaagaaugauuccucaaguagcucccauugccuggacccaaacaaugaggaaggugggcacggagugaaaggcugggcuuucgaugacggcaacgauguuuggauggggagaaccaucaaugagacaucuaggcuuggauaugagacuuuuaaggugauugaagguuggagcaaccccaaaucaaaguugcagauaaaucggcaggucaucguggaccguggcgaucgcaguggguacuccggaauuuucagcguagagggcaaaucuuguaucaacagaugcuuuuauguugaacugaucaggggucggaaggaggaaaccgaggugcuauggacaucaaauaguauugucguguucugugggacuagcggcaccuacggaacaggcuccuggccugacggggccgaucucaaccugaugccaauauga

SEQ ID NO: 147379 - RNA, 1410 nt, Artificial Sequence; identical to SEQ ID NO: 144162
  derived and/or modified sequence opt3 from neuraminidase__InfluenzaA__AHZ40444

SEQ ID NO: 147380 - RNA, 1410 nt, Artificial Sequence
  derived and/or modified sequence opt3 from neuraminidase__InfluenzaA__AHZ40456
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacaugcauucaaauaacaccguccgagaucguacacccuauagaacucuccugaugaaugaacuuggagugccuuuucaccugggcaccaagcagguuugcauugcuuggagcaguuccucuugucaugacgguaaagccugguugcacgugugcaucacaggggaugacaagaacgcaaccgccagcuucaucuacaauggaaggcucgucgauuccgugguaucauggaguaaagagauucugcggacgcaggaaagcgaguguguuugcauaaacggcacuuguacaguggucaugaccgacggcucugcuuccgggaaggcagauacuaaaauccuguuuauugaggaaggaaagaucgugcauacaucaacccucagcgguagugcccaacacguggaggaaugcucuugcuauccacgcuacccgggcgucagauguguuugcagggacaacuggaagggguccaaucggcccauaguggauauuaacaucaaagaccacagcaucguaucgucuuacguguguuccggauuagucggcgacacgccucgcaagaaugauucaaguagcuccucucauugccuggacccaaacaaugaggaaggugggcacggagugaaaggcugggcuuucgaugacggcaacgauguuuggauggggcgaaccauuaaugagacaagcagacuuggauaugagacuuuuaaggugaucgaagguuggucaaaccccaaaaguaaguugcagauuaauaggcaggucauaguggaccggggcgaucguuccggguacagcggaaucuucucuguagagggcaaaucauguauuaaccgcugcuuuuauguugaacugaucagagguaggaaggaggaaaccgaggugcuauggacaaguaauagcaucgucguguucugugggacuuccggcaccuacggaacaggcucuuggccugacggggccgaucucaaccugaugccaauuuga

SEQ ID NO: 147381 - RNA, 1410 nt, Artificial Sequence
  derived and/or modified sequence opt3 from neuraminidase__InfluenzaA__AHZ40468
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggaaacgacaagaaugcaaccgccagcuucaucuacaacggcaggcucguggauuccguaguuucauggaguaaagagauucugcggacgcaggaaagcgagugugugugcauaaacggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaauuggaagggauccaaccggcccauaguagauauuaauaucaaagaccacagcaucgugucgucuuacgucuguuccggcuuagugggugauacgccucgcaagaacgacucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 147382 - RNA, 1410 nt, Artificial Sequence; identical to SEQ ID NO: 145370
  derived and/or modified sequence opt3 from neuraminidase__InfluenzaA__AHZ40480

SEQ ID NO: 147383 - RNA, 1410 nt, Artificial Sequence; identical to SEQ ID NO: 146808
  derived and/or modified sequence opt3 from neuraminidase__InfluenzaA__AHZ40492

SEQ ID NO: 147384 - RNA, 1410 nt, Artificial Sequence; identical to SEQ ID NO: 144162
  derived and/or modified sequence opt3 from neuraminidase__InfluenzaA__AHZ40503

SEQ ID NO: 147385 - RNA, 1410 nt, Artificial Sequence; identical to SEQ ID NO: 144162
  derived and/or modified sequence opt3 from neuraminidase__InfluenzaA__AHZ40515

SEQ ID NO: 147386 - RNA, 1410 nt, Artificial Sequence
  derived and/or modified sequence opt3 from neuraminidase__InfluenzaA__AHZ40527
augaaccccaaucagaagaucauuaccauaggcagcgugucccugacaaucucuacuaugugcuucuuuaugcagauugccauccucauuacgaccgucacacuucacuucaaacaguacgaguuugacucaccuccaaacaaucagguuaugcugugugaaccgacuaucauagagagaaacaucaccgaaauuguguauuugacaaauaccacuaucgagaaggaaauuugccccaaaccugcugaguacaggaacuggaguaagccacagugugggaucacaggauucgcacccuuuagcaaagauaauuccauacgguuaucugccgguggcgacauuuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcaucgcuuggagcaguuccucuugucaugacgggaaggccugguugcacgucugcauuacaggagaugacaagaaugcaaccgccagcuucaucuacaacggcaggcucguggauuccguaguuucauggaguaaagagauccugcggacgcaggaaagcgagugugugugcauuaauggcacuuguacagucgugaugaccgacgggucugcuuccggaaaggcagauacuaaaauacuguuuaucgaggaagguaagauugugcauacaucaacccucagcggcagugcccaacacgucgaggaaugcucuugcuauccacgcuacccggggguuagaugugugugcagggacaacuggaagggauccaaccggcccaucguagauauaaauauuaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccaucaacgagacaagcagacuugguuaugagacuuuuaaggucauugaaggcuggucaaaucccaaaaguaaguugcagaucaacaggcaagugauuguagaccguggggaucgguccggauacagcggcauauucucuguugaggguaaaucauguaucaaucgcugcuuuuauguggaacugauuagagggaggaaggaggaaaccgagguccuauggacaaguaacagcaucguggucuucuguggcacuuccggaaccuacggcacagggucuuggccugacggagccgaucucaaucugaugccaaucuga

SEQ ID NO: 147387 - RNA, 1410 nt, Artificial Sequence
  derived and/or modified sequence opt3 from neuraminidase__InfluenzaA__AHZ40539
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugaacacaucaacccucagcggcagugcccaacaugucgaggaaugcucuugcuauccacgcuacccggggguuagaugugugugcagggauaauuggaagggauccaaccggcccauaguagacauuaauaucaaagaucacagcaucgugucgucuuacgucuguuccggcuuagugggugacacgccucgcaagaacgacucaaguagcuccucucacugccuggauccaaauaacgaggaagggggacauggcguuaaaggcugggcuuucgacgaugggaaugacguguggaugggacgaaccauuaacgagacaagcagacuugguuaugagacuuuuaaggucaucgaaggcuggucaaaucccaaaaguaaguugcagauuaacaggcaagugauaguagaucguggggaccgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugauggagccgaccucaaucugaugccaauuuga

SEQ ID NO: 147388 - RNA, 1410 nt, Artificial Sequence; identical to SEQ ID NO: 144162
  derived and/or modified sequence opt3 from neuraminidase__InfluenzaA__AHZ40551

SEQ ID NO: 147389 - RNA, 1410 nt, Artificial Sequence
  derived and/or modified sequence opt3 from neuraminidase__InfluenzaA__AHZ40563
augaaccccaaucagaagaucauuaccauaggcagcgugucccugacaaucucuacugucugcuucuuuaugcaaauugccauccucauuacgaccguuacacuucacuucaaacaguacgaguuuaacucaaguccuaauaaccaggugaugcugugugaaccaacuaucauagagagaaauaucaccgaaauuguauauuugacaaacaccacuaucgagaaggaaauuugcccgaaacccgcugaguacaggaauuggagcaagccucagugugggaucacaggauucgcaccauuuuccaaagacaacucuauacgguuaucggccgguggcgauauuugggugacccgcgagcccuaugucucaugcgacccugauaaguguuaccaauucgcgcuggggcagggaacgacucuaaauaacgugcauagcaauaacaccguucgagaccguacaccauauagaacucuccugaugaaugaacuuggcgugcccuuucaccuggguaccaagcaggucugcaucgcuuggaguuccucuagcugucaugaugggaaagccugguugcacgugugcauuacaggagacgauaagaacgcaaccgccuccuucaucuacaauggcaggcucguagacucaguugugaguuggagcaaagagauccugcggacgcaggaaucugagugugucugcauuaacggcacuuguacaguggugaugaccgauggguccgcuucaggaaaggcagacacuaaaauacuguuuaucgaggaagguaagauuguccauacaagcacccucaguggcucugcccaacacguugaggaaugcuccugcuauccucgcuacccaggggugagauguguaugcagggauaacuggaagggaagcaaucggccgaucguggacauaaacauuaaagaucacucgaucgucucuuccuacguguguucaggcuuaguuggugacacgccccgcaagaaugacaguagcuccucuagccauugccuggauccuaacaaugaggaagggggacacggcgugaaaggcugggcuuucgacgaugggaacgacgucuggaugggacgaaccaucaaugagacaucaagacuugguuaugagacuuuuaaggugauugaaggcuggaguaacuccaaaagcaaguugcagaucaauaggcagguaauuguugaucguggggaccggucuggauacucaggcauauucaguguggaggguaaaagcuguaucaaccgcugcuuuuaugucgaacugauuagagggaggaaggaggaaaccgaggugcuauggacauccaauucuaucgucguguucuguggcacuucgggaaccuacggcacagggagcuggccagauggagccgaccucaaccugaugcccaucuga

SEQ ID NO: 147390 - RNA, 1410 nt, Artificial Sequence
  derived and/or modified sequence opt3 from neuraminidase__InfluenzaA__AHZ40575
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuuccaggcaagugauaguagaucguggggaccggagcggauacucuggcaucuucucaguugaggguaaaaguuguauuaaucgcugcuuuuauguggaacugaucagagggaggaaggaggaaaccgagguccuauggacaagcaacuccaucguggucuucuguggcacuucuggaaccuacggcacagggucguggccugauggagccgaccucaaucugaugccaauuuga

SEQ ID NO: 147391 - RNA, 1410 nt, Artificial Sequence; identical to SEQ ID NO: 147109
  derived and/or modified sequence opt3 from neuraminidase__InfluenzaA__AHZ40586

SEQ ID NO: 147392 - RNA, 1410 nt, Artificial Sequence
  derived and/or modified sequence opt3 from neuraminidase__InfluenzaA__AHZ40598
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaauuucgcugcaggccagccuguggucucugugaaacuugccgggaacucgucacugugcccaguuagcggaugggcgauauacaguaaggacaauuccgugagaauuggcucuaaaggugaugucuuugugaucagggagccguucauuagcuguucccccuuggaaugccggaccuuuuucuuaacacagggggcucugcuaaacgacaagcauucaaauggaaccaucaaagaucgcaguccuuaucgaacucucaugagcuguccaaucggcgagguacccucuccuuacaacucccguuuugaaucaguugccuggagcgcaagugccugccacgacggcauuaacuggcugacaauagggaucucuggaccagauuccggugcuguggcaguccuuaaguauaauggcauuaucaccgacacgauaaagagcuggagaaacgauauucugaggacucaagagucggagugugccugcgugaaugggucuuguuucaccaucaugacagacggacccuccgauggccaggcuucauacaaaaucuuucggauugaaaaggguaaaaucgugaagagugucgagaugaacgccccuaauuaucauuacgaagagugcagcuguuacccagacuccucugagauuacuugcguuugccgcgauaacuggcacgggagcaauagaccgugggugucauucaaccagaauuuggaauaucagauaggauacaucuguaguggcauuuuuggcgacaaccccaggccuaaugauaaaaccggguccugcggaccaguaagcucuaacggugcgaauggcgugaagggguucucauuuaaguauggaaacggcgucuggaucggucggacaaaaaguaucagcucccgcaagggguucgagaugauuugggaccccaauggcuggaccggaacggacaacaacuuuucuauaaaacaagauaucgugggcauuaaugaauggucgggguacagcggauccuucguucagcauccugagcucacuggucuggacuguauccgaccaugcuucuggguggaacugauuagaggcaggcccaaggagaacacaaucuggaccucagggaguucuaucagcuuuuguggagucaauuccgauacugugggcuggucauggccggacggugcagagcucccuuucacaauagauaaauga

SEQ ID NO: 147393 - RNA, 1410 nt, Artificial Sequence; identical to SEQ ID NO: 144162
  derived and/or modified sequence opt3 from neuraminidase__InfluenzaA__AHZ40609

SEQ ID NO: 147394 - RNA, 1410 nt, Artificial Sequence; identical to SEQ ID NO: 145391
  derived and/or modified sequence opt3 from neuraminidase__InfluenzaA__AHZ40629

SEQ ID NO: 147395 - RNA, 1410 nt, Artificial Sequence; identical to SEQ ID NO: 145373
  derived and/or modified sequence opt3 from neuraminidase__InfluenzaA__AHZ40641

SEQ ID NO: 147396 - RNA, 1410 nt, Artificial Sequence
  derived and/or modified sequence opt3 from neuraminidase__InfluenzaA__AHZ40653
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcuggguacaggaauuggaguaagccacaguguggaauaacagguuucgcacccuuuagcaaagacaacuccauucgguuaucugccggcggggauaucuggguaacccgcgagccuuaugugucgugcgacccagauaaguguuaccaauucgcgcugggacagggcacgacucuaaauaacguccauucaaauaacaccgugcgagaccguacacccuauagaacucuccugaugaaugagcuugguguuccuuuucaccuggggaccaaacaggugugcauugcuuggagcaguuccucuugucaugauggaaaggccugguugcacgucugcaucacaggcgacgauaagaacgcaaccgccagcuucaucuacaauggcaggcucguggacuccguaguuucauggaguaaagaaauucugcggacgcaggagagcgaaugugugugcauaaacgggacuuguacagucgugaugaccgauggaucugcuuccgguaaggcagacacuaaaauccuguuuauugaggagggcaagaucgugcauacaucaacccucagcgggagugcccaacacgucgaagagugcucuugcuauccacgcuacccgggaguuagaugugugugcagggauaacuggaagggcuccaaucggcccauaguagacauuaacaucaaagaucacagcaucgugucgucuuacgucuguuccgguuuagugggggacacgccucgcaagaaugacucaaguagcuccucucauugccuggauccaaacaaugaagagggaggccacggcguuaaagggugggcuuucgacgauggaaacgacguguggaugggucgaaccauuaaugaaacaagcagacuuggcuaugagacuuuuaaggucaucgagggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 147397 - RNA, 1410 nt, Artificial Sequence; identical to SEQ ID NO: 145391
  derived and/or modified sequence opt3 from neuraminidase__InfluenzaA__AHZ40665

SEQ ID NO: 147398 - RNA, 1410 nt, Artificial Sequence; identical to SEQ ID NO: 145391
  derived and/or modified sequence opt3 from neuraminidase__InfluenzaA__AHZ40677

SEQ ID NO: 147399 - RNA, 1410 nt, Artificial Sequence; identical to SEQ ID NO: 144162
  derived and/or modified sequence opt3 from neuraminidase__InfluenzaA__AHZ40689

SEQ ID NO: 147400 - RNA, 1410 nt, Artificial Sequence
  derived and/or modified sequence opt3 from neuraminidase__InfluenzaA__AHZ40713
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggacaaauccggauacagcggcaucuucucuguugaggguaagucauguauuaaccggugcuuuuauguggaacugauccgcgggagaaaggaggaaaccgagguccuauggacaaguaauagcaucguggucuucuguggcacuuccggaaccuacggcacagggucuuggccugauggagccgaccucaaccugaugccaauuuga

SEQ ID NO: 147401 - RNA, 1410 nt, Artificial Sequence
  derived and/or modified sequence opt3 from neuraminidase__InfluenzaA__AHZ40725
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgggcuacgucuguucugguuuagugggggacacgccucgcaagaaugacuccucaaguagcucccauugccuggauccaaacaaugaggaaggaggccacggcguuaaagggugggcuuucgacgauggaaacgacguguggaugggucgaaccauuaaugagacaucuagacuuggcuaugagacuuuuaaggucaucgaaggguggagcaaccccaaaucaaaguugcagauuaauaggcaagugauaguagaucggggagaccguaguggcuacuccgguaucuucagcguugaggggaaaucuuguauuaaccgcugcuuuuauguggaacugaucagaggcaggaaggaggaaaccgagguccuauggacaucaaauaguaucguggucuucuguggaacuagcggcaccuacgggacaggauccuggccugauggugccgaccucaaccugaugccaauuuga

SEQ ID NO: 147402 - RNA, 1410 nt, Artificial Sequence; identical to SEQ ID NO: 145380
  derived and/or modified sequence opt3 from neuraminidase__InfluenzaA__AHZ40737

SEQ ID NO: 147403 - RNA, 1410 nt, Artificial Sequence
  derived and/or modified sequence opt3 from neuraminidase__InfluenzaA__AHZ40749
augaaccccaaucagaagaucauuaccauaggcagcgugucccugacaaucucuacuauuugccucuucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaaccugcugaguacaggaauuggaguaagccacagugugggauaacaggauuugcacccuucagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugaaugaacugggcguuccuuuccacuuggguaccaaacaggugugcauugcuuggagcaguuccucuugucaugaugggaaggccuggcuccacgucugcaucacaggagacgauaagaacgcaaccgccagcuuuaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcauacaucaaccuuaagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggccuggugggugacacgccucgcaagaaugacucaaguagcuccucucauugccuugauccaaacaaugaggaagggggacacggcguuaaaggcugggcuuuugacgaugggaacgacguguggaugggacgaaccauuaaugagacaagcagauuggguuaugagacuuucaaggucaucgaaggcuggucaaaccccaaaaguaagcugcagauuaauaggcaagugauaguagaucguggggaccgguccggauacagcggcaucuuuucuguugaggguaaaucauguauuaaccgcugcuucuauguggaacuaaucagagggaggaaggaggaaaccgagguccucuggacaaguaauagcaucguggucuuuuguggcacuuccggaaccuacggcacagggccuuggccagauggagccgaccugaaccuuaugcccauuuga

SEQ ID NO: 147404 - RNA, 1410 nt, Artificial Sequence
  derived and/or modified sequence opt3 from neuraminidase__InfluenzaA__AHZ40761
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaauuaugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcauggcuuggagcaguuccucuugucaugacgguaaggccuggcugcacgucugcaucacaggggaugacaagaacgcaaccgccagcuucauuuacaauggaaaacugguggauuccguaguuucauggaguaaggagauccucaggacgcaggaaagcgagugugugugcaucaacggcacuuguacagucgugaugaccgacggcucugcuuccgggaaagcagauacuaagauuuuauuuauagaggaaggaaagaucgugcauacaucaacccugagcgguagugcccaacacgucgaggaaugcucuugcuauccucgguacccaggcguucgcugugugugcagagacaacuggaaaggguccaauaggccgauuguagauaucaacauaaaggaccacagcauugugucgucuuacgucuguuccggacuugugggcgacacgccccggaaaaccgauucaaguagcuccucucauugcuuggacccuaauaacgaggaaggugggcacggaguuaagggcugggcuuucgaugacggcaaugauguguggauggggcgcacaaucaacgagacuagccgacugggauaugagaccuuuaaagucaucgaagguuggucaaauccaaagaguaaacuacagauuaacagacaggugaucguagacaggggcgaucgguccggguacagcggaauuuucucuguugagggcaagucauguauaaaucguugcuuuuauguggaacucauccgcgguagaaagaaagagacagccguccuguggaccaguaacagcauuguggucuucugugggacuuccggcacauacggaaccggcucuuggcccgacggggcggaucuuaaucugaugccuaucuga

SEQ ID NO: 147405 - RNA, 1410 nt, Artificial Sequence; identical to SEQ ID NO: 144162
  derived and/or modified sequence opt3 from neuraminidase__InfluenzaA__AHZ40773

SEQ ID NO: 147406 - RNA, 1410 nt, Artificial Sequence; identical to SEQ ID NO: 138744
  derived and/or modified sequence opt3 from neuraminidase__InfluenzaA__AHZ40785

SEQ ID NO: 147407 - RNA, 1410 nt, Artificial Sequence; identical to SEQ ID NO: 138744
  derived and/or modified sequence opt3 from neuraminidase__InfluenzaA__AHZ40796

SEQ ID NO: 147408 - RNA, 1410 nt, Artificial Sequence; identical to SEQ ID NO: 138744
  derived and/or modified sequence opt3 from neuraminidase__InfluenzaA__AHZ40807

SEQ ID NO: 147409 - RNA, 1410 nt, Artificial Sequence; identical to SEQ ID NO: 138744
  derived and/or modified sequence opt3 from neuraminidase__InfluenzaA__AHZ40818

SEQ ID NO: 147410 - RNA, 1410 nt, Artificial Sequence; identical to SEQ ID NO: 138744
  derived and/or modified sequence opt3 from neuraminidase__InfluenzaA__AHZ40829

SEQ ID NO: 147411 - RNA, 1410 nt, Artificial Sequence; identical to SEQ ID NO: 138744
  derived and/or modified sequence opt3 from neuraminidase__InfluenzaA__AHZ40840

SEQ ID NO: 147412 - RNA, 1410 nt, Artificial Sequence; identical to SEQ ID NO: 138744
  derived and/or modified sequence opt3 from neuraminidase__InfluenzaA__AHZ40851

SEQ ID NO: 147413 - RNA, 1410 nt, Artificial Sequence; identical to SEQ ID NO: 138744
  derived and/or modified sequence opt3 from neuraminidase__InfluenzaA__AHZ40862

SEQ ID NO: 147414 - RNA, 1410 nt, Artificial Sequence; identical to SEQ ID NO: 138744
  derived and/or modified sequence opt3 from neuraminidase__InfluenzaA__AHZ40873

SEQ ID NO: 147415 - RNA, 1410 nt, Artificial Sequence; identical to SEQ ID NO: 138744
  derived and/or modified sequence opt3 from neuraminidase__InfluenzaA__AHZ40884

SEQ ID NO: 147416 - RNA, 1410 nt, Artificial Sequence; identical to SEQ ID NO: 138744
  derived and/or modified sequence opt3 from neuraminidase__InfluenzaA__AHZ40895

SEQ ID NO: 147417 - RNA, 1410 nt, Artificial Sequence; identical to SEQ ID NO: 138744
  derived and/or modified sequence opt3 from neuraminidase__InfluenzaA__AHZ40906

SEQ ID NO: 147418 - RNA, 1410 nt, Artificial Sequence; identical to SEQ ID NO: 138744
  derived and/or modified sequence opt3 from neuraminidase__InfluenzaA__AHZ40917

SEQ ID NO: 147419 - RNA, 1410 nt, Artificial Sequence; identical to SEQ ID NO: 138744
  derived and/or modified sequence opt3 from neuraminidase__InfluenzaA__AHZ40928

SEQ ID NO: 147420 - RNA, 1410 nt, Artificial Sequence; identical to SEQ ID NO: 138744
  derived and/or modified sequence opt3 from neuraminidase__InfluenzaA__AHZ40939

SEQ ID NO: 147421 - RNA, 1410 nt, Artificial Sequence; identical to SEQ ID NO: 138744
  derived and/or modified sequence opt3 from neuraminidase__InfluenzaA__AHZ40950

SEQ ID NO: 147422 - RNA, 1410 nt, Artificial Sequence; identical to SEQ ID NO: 138744
  derived and/or modified sequence opt3 from neuraminidase__InfluenzaA__AHZ40961

SEQ ID NO: 147423 - RNA, 1410 nt, Artificial Sequence; identical to SEQ ID NO: 138744
  derived and/or modified sequence opt3 from neuraminidase__InfluenzaA__AHZ40972

SEQ ID NO: 147424 - RNA, 1410 nt, Artificial Sequence; identical to SEQ ID NO: 138744
  derived and/or modified sequence opt3 from neuraminidase__InfluenzaA__AHZ40983

SEQ ID NO: 147425 - RNA, 1410 nt, Artificial Sequence; identical to SEQ ID NO: 138744
  derived and/or modified sequence opt3 from neuraminidase__InfluenzaA__AHZ40994

SEQ ID NO: 147426 - RNA, 1410 nt, Artificial Sequence; identical to SEQ ID NO: 138744
  derived and/or modified sequence opt3 from neuraminidase__InfluenzaA__AHZ41005

SEQ ID NO: 147427 - RNA, 1410 nt, Artificial Sequence; identical to SEQ ID NO: 138744
  derived and/or modified sequence opt3 from neuraminidase__InfluenzaA__AHZ41016

SEQ ID NO: 147428 - RNA, 1410 nt, Artificial Sequence; identical to SEQ ID NO: 138744
  derived and/or modified sequence opt3 from neuraminidase__InfluenzaA__AHZ41027

SEQ ID NO: 147429 - RNA, 1410 nt, Artificial Sequence; identical to SEQ ID NO: 138744
  derived and/or modified sequence opt3 from neuraminidase__InfluenzaA__AHZ41049

SEQ ID NO: 147430 - RNA, 1410 nt, Artificial Sequence; identical to SEQ ID NO: 138744
  derived and/or modified sequence opt3 from neuraminidase__InfluenzaA__AHZ41060

SEQ ID NO: 147431 - RNA, 1410 nt, Artificial Sequence; identical to SEQ ID NO: 138744
  derived and/or modified sequence opt3 from neuraminidase__InfluenzaA__AHZ41071

SEQ ID NO: 147432 - RNA, 1410 nt, Artificial Sequence; identical to SEQ ID NO: 138744
  derived and/or modified sequence opt3 from neuraminidase__InfluenzaA__AHZ41082

SEQ ID NO: 147433 - RNA, 1410 nt, Artificial Sequence; identical to SEQ ID NO: 138744
  derived and/or modified sequence opt3 from neuraminidase__InfluenzaA__AHZ41093

SEQ ID NO: 147434 - RNA, 1410 nt, Artificial Sequence; identical to SEQ ID NO: 138744
  derived and/or modified sequence opt3 from neuraminidase__InfluenzaA__AHZ41104

SEQ ID NO: 147435 - RNA, 1410 nt, Artificial Sequence; identical to SEQ ID NO: 138744
  derived and/or modified sequence opt3 from neuraminidase__InfluenzaA__AHZ41115

SEQ ID NO: 147436 - RNA, 1410 nt, Artificial Sequence; identical to SEQ ID NO: 138744
  derived and/or modified sequence opt3 from neuraminidase__InfluenzaA__AHZ41126

SEQ ID NO: 147437 - RNA, 1410 nt, Artificial Sequence; identical to SEQ ID NO: 138744
  derived and/or modified sequence opt3 from neuraminidase__InfluenzaA__AHZ41137

SEQ ID NO: 147438 - RNA, 1410 nt, Artificial Sequence; identical to SEQ ID NO: 138744
  derived and/or modified sequence opt3 from neuraminidase__InfluenzaA__AHZ41148

SEQ ID NO: 147439 - RNA, 1410 nt, Artificial Sequence; identical to SEQ ID NO: 138744
  derived and/or modified sequence opt3 from neuraminidase__InfluenzaA__AHZ41159

SEQ ID NO: 147440 - RNA, 1410 nt, Artificial Sequence; identical to SEQ ID NO: 138744
  derived and/or modified sequence opt3 from neuraminidase__InfluenzaA__AHZ41170

SEQ ID NO: 147441 - RNA, 1410 nt, Artificial Sequence; identical to SEQ ID NO: 138744
  derived and/or modified sequence opt3 from neuraminidase__InfluenzaA__AHZ41181

SEQ ID NO: 147442 - RNA, 1410 nt, Artificial Sequence; identical to SEQ ID NO: 138744
  derived and/or modified sequence opt3 from neuraminidase__InfluenzaA__AHZ41205

SEQ ID NO: 147443 - RNA, 1410 nt, Artificial Sequence; identical to SEQ ID NO: 138744
  derived and/or modified sequence opt3 from neuraminidase__InfluenzaA__AHZ41251

SEQ ID NO: 147444 - RNA, 1410 nt, Artificial Sequence; identical to SEQ ID NO: 138744
  derived and/or modified sequence opt3 from neuraminidase__InfluenzaA__AHZ41266

SEQ ID NO: 147445 - RNA, 1410 nt, Artificial Sequence; identical to SEQ ID NO: 138744
  derived and/or modified sequence opt3 from neuraminidase__InfluenzaA__AHZ41284

SEQ ID NO: 147446 - RNA, 1410 nt, Artificial Sequence; identical to SEQ ID NO: 138744
  derived and/or modified sequence opt3 from neuraminidase__InfluenzaA__AHZ41295

SEQ ID NO: 147447 - RNA, 1410 nt, Artificial Sequence; identical to SEQ ID NO: 138744
  derived and/or modified sequence opt3 from neuraminidase__InfluenzaA__AHZ41306

SEQ ID NO: 147448 - RNA, 1410 nt, Artificial Sequence; identical to SEQ ID NO: 138744
  derived and/or modified sequence opt3 from neuraminidase__InfluenzaA__AHZ41317

SEQ ID NO: 147449 - RNA, 1410 nt, Artificial Sequence; identical to SEQ ID NO: 138744
  derived and/or modified sequence opt3 from neuraminidase__InfluenzaA__AHZ41328

SEQ ID NO: 147450 - RNA, 1410 nt, Artificial Sequence; identical to SEQ ID NO: 138744
  derived and/or modified sequence opt3 from neuraminidase__InfluenzaA__AHZ41339

SEQ ID NO: 147451 - RNA, 1410 nt, Artificial Sequence; identical to SEQ ID NO: 138744
  derived and/or modified sequence opt3 from neuraminidase__InfluenzaA__AHZ41350

SEQ ID NO: 147452 - RNA, 1410 nt, Artificial Sequence; identical to SEQ ID NO: 138744
  derived and/or modified sequence opt3 from neuraminidase__InfluenzaA__AHZ41369

SEQ ID NO: 147453 - RNA, 1410 nt, Artificial Sequence; identical to SEQ ID NO: 138744
  derived and/or modified sequence opt3 from neuraminidase__InfluenzaA__AHZ41380

SEQ ID NO: 147454 - RNA, 1410 nt, Artificial Sequence; identical to SEQ ID NO: 138744
  derived and/or modified sequence opt3 from neuraminidase__InfluenzaA__AHZ41391

SEQ ID NO: 147455 - RNA, 1410 nt, Artificial Sequence; identical to SEQ ID NO: 138744
  derived and/or modified sequence opt3 from neuraminidase__InfluenzaA__AHZ41402

SEQ ID NO: 147456 - RNA, 1410 nt, Artificial Sequence; identical to SEQ ID NO: 138744
  derived and/or modified sequence opt3 from neuraminidase__InfluenzaA__AHZ41413

SEQ ID NO: 147457 - RNA, 1410 nt, Artificial Sequence; identical to SEQ ID NO: 138744
  derived and/or modified sequence opt3 from neuraminidase__InfluenzaA__AHZ41444

SEQ ID NO: 147458 - RNA, 1410 nt, Artificial Sequence; identical to SEQ ID NO: 138744
  derived and/or modified sequence opt3 from neuraminidase__InfluenzaA__AHZ41455

SEQ ID NO: 147459 - RNA, 1410 nt, Artificial Sequence; identical to SEQ ID NO: 138744
  derived and/or modified sequence opt3 from neuraminidase__InfluenzaA__AHZ41476

SEQ ID NO: 147460 - RNA, 1410 nt, Artificial Sequence; identical to SEQ ID NO: 138744
  derived and/or modified sequence opt3 from neuraminidase__InfluenzaA__AHZ41487

SEQ ID NO: 147461 - RNA, 1410 nt, Artificial Sequence; identical to SEQ ID NO: 138744
  derived and/or modified sequence opt3 from neuraminidase__InfluenzaA__AHZ41498

SEQ ID NO: 147462 - RNA, 1410 nt, Artificial Sequence; identical to SEQ ID NO: 138744
  derived and/or modified sequence opt3 from neuraminidase__InfluenzaA__AHZ41509

SEQ ID NO: 147463 - RNA, 1410 nt, Artificial Sequence; identical to SEQ ID NO: 138744
  derived and/or modified sequence opt3 from neuraminidase__InfluenzaA__AHZ41520

SEQ ID NO: 147464 - RNA, 1410 nt, Artificial Sequence; identical to SEQ ID NO: 138744
  derived and/or modified sequence opt3 from neuraminidase__InfluenzaA__AHZ41531

SEQ ID NO: 147465 - RNA, 1410 nt, Artificial Sequence; identical to SEQ ID NO: 138744
  derived and/or modified sequence opt3 from neuraminidase__InfluenzaA__AHZ41542

SEQ ID NO: 147466 - RNA, 1410 nt, Artificial Sequence; identical to SEQ ID NO: 138744
  derived and/or modified sequence opt3 from neuraminidase__InfluenzaA__AHZ41553

SEQ ID NO: 147467 - RNA, 1410 nt, Artificial Sequence; identical to SEQ ID NO: 138744
  derived and/or modified sequence opt3 from neuraminidase__InfluenzaA__AHZ41564

SEQ ID NO: 147468 - RNA, 1410 nt, Artificial Sequence; identical to SEQ ID NO: 138744
  derived and/or modified sequence opt3 from neuraminidase__InfluenzaA__AHZ41586

SEQ ID NO: 147469 - RNA, 1410 nt, Artificial Sequence; identical to SEQ ID NO: 138744
  derived and/or modified sequence opt3 from neuraminidase__InfluenzaA__AHZ41597

SEQ ID NO: 147470 - RNA, 1410 nt, Artificial Sequence; identical to SEQ ID NO: 138744
  derived and/or modified sequence opt3 from neuraminidase__InfluenzaA__AHZ41608

SEQ ID NO: 147471 - RNA, 1410 nt, Artificial Sequence; identical to SEQ ID NO: 138744
  derived and/or modified sequence opt3 from neuraminidase__InfluenzaA__AHZ41619

SEQ ID NO: 147472 - RNA, 1410 nt, Artificial Sequence; identical to SEQ ID NO: 138744
  derived and/or modified sequence opt3 from neuraminidase__InfluenzaA__AHZ41630

SEQ ID NO: 147473 - RNA, 1410 nt, Artificial Sequence; identical to SEQ ID NO: 138744
  derived and/or modified sequence opt3 from neuraminidase__InfluenzaA__AHZ41641

SEQ ID NO: 147474 - RNA, 1410 nt, Artificial Sequence; identical to SEQ ID NO: 138744
  derived and/or modified sequence opt3 from neuraminidase__InfluenzaA__AHZ41652

SEQ ID NO: 147475 - RNA, 1410 nt, Artificial Sequence; identical to SEQ ID NO: 138744
  derived and/or modified sequence opt3 from neuraminidase__InfluenzaA__AHZ41663

SEQ ID NO: 147476 - RNA, 1410 nt, Artificial Sequence; identical to SEQ ID NO: 138744
  derived and/or modified sequence opt3 from neuraminidase__InfluenzaA__AHZ41674

SEQ ID NO: 147477 - RNA, 1410 nt, Artificial Sequence; identical to SEQ ID NO: 138744
  derived and/or modified sequence opt3 from neuraminidase__InfluenzaA__AHZ41685

SEQ ID NO: 147478 - RNA, 1410 nt, Artificial Sequence; identical to SEQ ID NO: 138744
  derived and/or modified sequence opt3 from neuraminidase__InfluenzaA__AHZ41696

SEQ ID NO: 147479 - RNA, 1410 nt, Artificial Sequence; identical to SEQ ID NO: 138744
  derived and/or modified sequence opt3 from neuraminidase__InfluenzaA__AHZ41707

SEQ ID NO: 147480 - RNA, 1410 nt, Artificial Sequence; identical to SEQ ID NO: 138744
  derived and/or modified sequence opt3 from neuraminidase__InfluenzaA__AHZ41718

SEQ ID NO: 147481 - RNA, 1410 nt, Artificial Sequence; identical to SEQ ID NO: 138744
  derived and/or modified sequence opt3 from neuraminidase__InfluenzaA__AHZ41729

SEQ ID NO: 147482 - RNA, 1410 nt, Artificial Sequence; identical to SEQ ID NO: 138744
  derived and/or modified sequence opt3 from neuraminidase__InfluenzaA__AHZ41740

SEQ ID NO: 147483 - RNA, 1410 nt, Artificial Sequence; identical to SEQ ID NO: 138744
  derived and/or modified sequence opt3 from neuraminidase__InfluenzaA__AHZ41751

SEQ ID NO: 147484 - RNA, 1410 nt, Artificial Sequence; identical to SEQ ID NO: 138744
  derived and/or modified sequence opt3 from neuraminidase__InfluenzaA__AHZ41762

SEQ ID NO: 147485 - RNA, 1410 nt, Artificial Sequence; identical to SEQ ID NO: 145405
  derived and/or modified sequence opt3 from neuraminidase__InfluenzaA__AHZ42564

SEQ ID NO: 147486 - RNA, 1410 nt, Artificial Sequence; identical to SEQ ID NO: 144162
  derived and/or modified sequence opt3 from neuraminidase__InfluenzaA__AHZ42575

SEQ ID NO: 147487 - RNA, 1410 nt, Artificial Sequence
  derived and/or modified sequence opt3 from neuraminidase__InfluenzaA__AHZ42587
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaugugccccaaaccugcugaguacaggaauuggaguaagccacagugugggaucacaggauucgcacccuuuagcaaagacaacuccauacgguuaucugccgguggcgauauuuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcaucgcuuggagcaguuccucuugucaugaugggaaggccugguugcacgucugcauuacaggagacgauaagaacgcaaccgccagcuucaucuacaauggcaggcucguggacuccguaguuucauggaguaaagagauccugcggacgcaggaaagcgagugugugugcauuaacggcacuuguacagucgugaugaccgaugggucugcuuccggaaaggcagacacuaaaauacuguuuaucgaggaagguaagauugugcauacaucaacccucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccaucaaugagacaagcagacuugguuaugagacuuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaaccgagguccuauggacaaguaauagcaucguggucuucuguggcacuuccggaaccuacggcacagggucuuggccugauggagccgaccucaaccugaugccaaucuga

SEQ ID NO: 147488 - RNA, 1413 nt, Artificial Sequence
  derived and/or modified sequence opt3 from neuraminidase__InfluenzaA__AHZ42599
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaagaauaaccagguuaugcugugugaaccgacuauaaucgagagaaauauuaccgaaaucguguauuugacaaacaccacuauugagaaagaaaucugccccaagccugcugaguacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggagauucugcggacgcaggaaagcgagugugugugcauaaacggcacuuguacagucgugaugaccgaugggucugcuuccgagaaagcagacacuaagauccuguuuauugaagagggaaagaucgugcauacaucaacccucagcgguagugcccaacacgucgaagagugcucuugcuauccacgcuacccgggcguuagaugugugugcagggauaacuggaaaggguccaaucggcccauaguagacauuaacaucaaggaucacagcaucgugucgucuuacgucuguuccggauuagugggcgacacgccucgcaaaaaugacucaaguagcuccucucauugccuggauccaaacaaugaagagggugggcacggaguuaagggcugggcuuucgacgauggcaacgacguguggauggggcgaaccauuaaugagacaagcagacuuggauaugaaacuuuuaaagucaucgaggguuggucaaaccccaagaguaaauugcagauuaauaggcaagugauaguagaucggggcgaccguuccggguacagcggaaucuucucuguugaaggcaagucauguauuaaccgcugcuuuuauguggagcugaucagagguaggaaggaagagaccgagguccuauggacaaguaauagcaucguggucuucugugggacuuccggcaccuacggaacaggcucuuggccugauggggccgaccucaaccugaugccaauuuga

SEQ ID NO: 147489 - RNA, 1410 nt, Artificial Sequence; identical to SEQ ID NO: 146808
  derived and/or modified sequence opt3 from neuraminidase__InfluenzaA__AHZ42611

SEQ ID NO: 147490 - RNA, 1410 nt, Artificial Sequence; identical to SEQ ID NO: 144162
  derived and/or modified sequence opt3 from neuraminidase__InfluenzaA__AHZ42622

SEQ ID NO: 147491 - RNA, 1410 nt, Artificial Sequence; identical to SEQ ID NO: 147349
  derived and/or modified sequence opt3 from neuraminidase__InfluenzaA__AHZ42634

SEQ ID NO: 147492 - RNA, 1410 nt, Artificial Sequence; identical to SEQ ID NO: 147392
  derived and/or modified sequence opt3 from neuraminidase__InfluenzaA__AHZ42646

SEQ ID NO: 147493 - RNA, 1410 nt, Artificial Sequence; identical to SEQ ID NO: 144162
  derived and/or modified sequence opt3 from neuraminidase__InfluenzaA__AHZ42657

SEQ ID NO: 147494 - RNA, 1410 nt, Artificial Sequence; identical to SEQ ID NO: 147109
  derived and/or modified sequence opt3 from neuraminidase__InfluenzaA__AHZ42669

SEQ ID NO: 147495 - RNA, 1410 nt, Artificial Sequence; identical to SEQ ID NO: 144162
  derived and/or modified sequence opt3 from neuraminidase__InfluenzaA__AHZ42681

SEQ ID NO: 147496 - RNA, 1410 nt, Artificial Sequence
  derived and/or modified sequence opt3 from neuraminidase__InfluenzaA__AHZ42693
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggagaaacaauauuuugaggacucaagagucugagugugccugcgucaacggguccuguuucaccaucaugacagauggaccaucagacggccaggcuaguuacaaaaucuuucggauugaaaaggguaaaaucgugaagucaguggagaugaaugcccccaacuaucauuacgaagagugcuccuguuacccugauucuagcgagauuacuugcgucugccgcgacaauuggcacgggucaaacagaccauggguuaguuucaaucagaaccucgaauaucagauaggauacaucuguuccggcauuuuuggcgauaauccgaggcccaacgacaaaaccgggagcugcggaccugugucuucaaauggugcgaacggcguaaagggguucaguuuuaaguauggaaauggcguguggaucggucggacaaaaagcaucuccucucgcaagggguucgagaugauuugggauccaaacggcuggaccggaacggacaacaauuuuucgauaaaacaagacaucgucggcauuaacgaauggagcggguacuccggaucauucgugcagcaucccgagcugacugguauggauuguauccgaccuugcuucuggguugaacugauuagaggcaggccaaaggagaauacaaucuggaccagugggucuauaaucagcuuuuguggagugaacuccgacacugucggcuggucauggcccgauggugcagagcucccguucacaauugacaaauga

SEQ ID NO: 147497 - RNA, 1410 nt, Artificial Sequence; identical to SEQ ID NO: 144162
  derived and/or modified sequence opt3 from neuraminidase__InfluenzaA__AHZ42704

SEQ ID NO: 147498 - RNA, 1410 nt, Artificial Sequence
  derived and/or modified sequence opt3 from neuraminidase__InfluenzaA__AHZ42716
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguuccagauuaauaggcaagugauaguagaucguggggaccgguccggauacagcggcaucuuuucuguugaggguaaaucauguauuaaccgcugcuucuauguggaauugaucagagggaggaaggaggaaaccgagguccuguggacaaguaauagcaucguggucuucuguggcacuuccggaaccuacggcacagggucuuggccugauggagccgaccuaaaccucaugccaauuuga

SEQ ID NO: 147499 - RNA, 1410 nt, Artificial Sequence; identical to SEQ ID NO: 144162
  derived and/or modified sequence opt3 from neuraminidase__InfluenzaA__AHZ42728

SEQ ID NO: 147500 - RNA, 1410 nt, Artificial Sequence; identical to SEQ ID NO: 145405
  derived and/or modified sequence opt3 from neuraminidase__InfluenzaA__AHZ42740

SEQ ID NO: 147501 - RNA, 1410 nt, Artificial Sequence; identical to SEQ ID NO: 145373
  derived and/or modified sequence opt3 from neuraminidase__InfluenzaA__AHZ42751

SEQ ID NO: 147502 - RNA, 1410 nt, Artificial Sequence
  derived and/or modified sequence opt3 from neuraminidase__InfluenzaA__AHZ42763
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucguguauacaucaacccucagcgguagugcccaacaugucgaggaaugcucuugcuacccacgcuacccgggcguuagaugugugugcagggacaacuggaagggguccaaucggcccauaguagauauuaacaucaaagaccacagcaucgugucgcgcuaugucuguucuggauuagugggcgacacgccucgaaagaaugauuccucaaguagcucccacugccuggacccaaacaaugaggaaggugggcauggaguuaaaggcugggcuuucgaugacggcaacgauguguggauggggagaaccauuaaugagacaucuaggcuuggauacgagacuuuuaaggucaucgaagguuggagcaaccccaaaucaaaguugcagauuaaucgucaggugauaguagaccggggcgaucgcaguggguauuccggaaucuucagcguugagggcaaaucuuguauuaacagaugcuuuuacguggaacugaucaggggucggaaggaggaaaccgagguccuauggacaucaaauaguaucguggucuucugugggacuagcggcaccuauggaacaggcuccuggccugacggggccgaucucaaccugaugccaauuuga

SEQ ID NO: 147503 - RNA, 1410 nt, Artificial Sequence; identical to SEQ ID NO: 145391
  derived and/or modified sequence opt3 from neuraminidase__InfluenzaA__AHZ42775

SEQ ID NO: 147504 - RNA, 1410 nt, Artificial Sequence; identical to SEQ ID NO: 144162
  derived and/or modified sequence opt3 from neuraminidase__InfluenzaA__AHZ42787

SEQ ID NO: 147505 - RNA, 1410 nt, Artificial Sequence
  derived and/or modified sequence opt3 from neuraminidase__InfluenzaA__AHZ42799
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaauugacaucaacaucaaagaucacagcauuguaucgucuuacguguguuccggcuuagucggugacacgccucgcaagaaugacucaaguagcuccucucauugccuggauccaaacaaugaggaagggggacacggcgugaaaggcugggcuuucgacgaugggaacgacguuuggaugggacgaaccaucaaugagacaagcagacuugguuaugagacuuuuaaggugauugaaggcuggucaaaccccaaaaguaaguugcagauaaauaggcaggucaucguggaucguggggaccgguccggauacagcggcauuuucucuguagaggguaaaucauguaucaaccgcugcuuuuauguugaacugaucagagggaggaaggaggaaaccgaggugcuauggacaaguaauagcauugucguguucuguggcacuuccggaaccuacggcacagggucuuggccugauggagccgaccucaaccugaugccaauauga

SEQ ID NO: 147506 - RNA, 1410 nt, Artificial Sequence
  derived and/or modified sequence opt3 from neuraminidase__InfluenzaA__AHZ42811
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagggcggggagaucguuccggcuacagcgguaucuucucuguugaggggaaaucauguauuaaccgcugcuuuuauguggaacugaucagaggcaggaaggaggaaaccgagguccuauggacaaguaauagcaucguggucuucuguggaacuuccggcaccuacgggacaggaucuuggccugacggugccgaucucaaccugaugccaauuuga

SEQ ID NO: 147507 - RNA, 1410 nt, Artificial Sequence
  derived and/or modified sequence opt3 from neuraminidase__InfluenzaA__AHZ42823
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcagagcagucuguagugucggucaaacuggccggcaacagcagcuugugcccugugagugggugggcgauauacuccaaggacaauucuguuagaauuggaagcaaaggcgauguguuugucaucagggaaccauucauuuccuguucaccguuagagugccggaccuuuuuccugacacagggugcucuacucaacgacaagcauaguaaugggaccaucaaagaucgcagccccuaucgaacucugaugucuuguccuaucggagaagugccaucccccuacaacucacguuuugagagcguagccuggagugcaucugccugccacgacggcauuaacuggcuuacaauaggcaucuccgggccugauagcggagcuguugcagugcugaaguauaaugguauuaucaccgacacgauaaagucguggagaaacaauauuuugaggacucaagagucugaaugugccugcgucaacggcuccuguuucaccaucaugacagaugggccaucagacggacaggcuaguuacaaaaucuuucggauugagaagggcaaaaucgugaagucaguggaaaugaaugcccccaacuaucauuacgaggagugcuccuguuacccugauucuagcgaaauuacuugcgucugccgcgacaauuggcacgguucaaacagaccauggguuaguuucaaucagaaccucgaguaucagauaggguacaucuguuccggaauuuuuggcgauaauccgaggcccaacgacaaaaccggcagcugcgggccugugucuucaaauggagcgaacgguguaaagggcuucaguuuuaaguaugggaauggaguguggaucggccggacaaaaagcaucuccucucgcaaggguuucgaaaugauuugggauccaaacggguggaccggcacggacaacaauuuuucgauaaaacaagacaucgucggaauuaacgaguggagcggcuacuccgggucauucgugcagcaucccgaacugacuggacuggauuguauccgaccuugcuucuggguugagcucauuagagguaggccaaaggagaauacaaucuggaccaguggcucuagcauauccuuuuguggggugaacucagacacugucggauggagcuggcccgauggcgcagaauuaccguucacaaucgacaaauga

SEQ ID NO: 147508 - RNA, 1410 nt, Artificial Sequence
  derived and/or modified sequence opt3 from neuraminidase__InfluenzaA__AHZ42834
augaaccccaaucagaagaucauuaccauaggcagcgugucccugacaaucucuacuauuugcuucuuuaugcagacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147509 - RNA, 1410 nt, Artificial Sequence; identical to SEQ ID NO: 144162
  derived and/or modified sequence opt3 from neuraminidase__InfluenzaA__AHZ42846

SEQ ID NO: 147510 - RNA, 1410 nt, Artificial Sequence; identical to SEQ ID NO: 144162
  derived and/or modified sequence opt3 from neuraminidase__InfluenzaA__AHZ42858

SEQ ID NO: 147511 - RNA, 1410 nt, Artificial Sequence; identical to SEQ ID NO: 144162
  derived and/or modified sequence opt3 from neuraminidase__InfluenzaA__AHZ42870

SEQ ID NO: 147512 - RNA, 1410 nt, Artificial Sequence; identical to SEQ ID NO: 144162
  derived and/or modified sequence opt3 from neuraminidase__InfluenzaA__AHZ42882

SEQ ID NO: 147513 - RNA, 1410 nt, Artificial Sequence
  derived and/or modified sequence opt3 from neuraminidase__InfluenzaA__AHZ42894
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagauaaaggggaccgguccggauacagcggcaucuucucuguugaggguaagucauguauuaaccguugcuuuuauguggaacugauccgcgggagaaaggaggaaaccgagguccuauggacaaguaauagcaucguggucuucuguggcacuuccggaaccuacggcacagggucuuggccugauggagccgaccucaaccugaugccaauuuga

SEQ ID NO: 147514 - RNA, 1410 nt, Artificial Sequence; identical to SEQ ID NO: 144162
  derived and/or modified sequence opt3 from neuraminidase__InfluenzaA__AHZ42906

SEQ ID NO: 147515 - RNA, 1410 nt, Artificial Sequence; identical to SEQ ID NO: 145391
  derived and/or modified sequence opt3 from neuraminidase__InfluenzaA__AHZ42918

SEQ ID NO: 147516 - RNA, 1398 nt, Artificial Sequence; identical to SEQ ID NO: 145470
  derived and/or modified sequence opt3 from neuraminidase__InfluenzaA__AHZ59750

SEQ ID NO: 147517 - RNA, 1398 nt, Artificial Sequence; identical to SEQ ID NO: 145470
  derived and/or modified sequence opt3 from neuraminidase__InfluenzaA__AHZ59762

SEQ ID NO: 147518 - RNA, 1398 nt, Artificial Sequence; identical to SEQ ID NO: 145470
  derived and/or modified sequence opt3 from neuraminidase__InfluenzaA__AHZ59774

SEQ ID NO: 147519 - RNA, 1398 nt, Artificial Sequence; identical to SEQ ID NO: 145470
  derived and/or modified sequence opt3 from neuraminidase__InfluenzaA__AHZ59786

SEQ ID NO: 147520 - RNA, 1398 nt, Artificial Sequence; identical to SEQ ID NO: 145470
  derived and/or modified sequence opt3 from neuraminidase__InfluenzaA__AHZ59798

SEQ ID NO: 147521 - RNA, 1398 nt, Artificial Sequence; identical to SEQ ID NO: 145470
  derived and/or modified sequence opt3 from neuraminidase__InfluenzaA__AHZ59810

SEQ ID NO: 147522 - RNA, 1398 nt, Artificial Sequence; identical to SEQ ID NO: 145470
  derived and/or modified sequence opt3 from neuraminidase__InfluenzaA__AHZ59822

SEQ ID NO: 147523 - RNA, 1398 nt, Artificial Sequence; identical to SEQ ID NO: 145470
  derived and/or modified sequence opt3 from neuraminidase__InfluenzaA__AHZ59834

SEQ ID NO: 147524 - RNA, 1398 nt, Artificial Sequence; identical to SEQ ID NO: 145470
  derived and/or modified sequence opt3 from neuraminidase__InfluenzaA__AHZ59846

SEQ ID NO: 147525 - RNA, 1398 nt, Artificial Sequence; identical to SEQ ID NO: 145470
  derived and/or modified sequence opt3 from neuraminidase__InfluenzaA__AHZ59858

SEQ ID NO: 147526 - RNA, 1398 nt, Artificial Sequence; identical to SEQ ID NO: 145470
  derived and/or modified sequence opt3 from neuraminidase__InfluenzaA__AHZ59870

SEQ ID NO: 147527 - RNA, 1398 nt, Artificial Sequence; identical to SEQ ID NO: 145470
  derived and/or modified sequence opt3 from neuraminidase__InfluenzaA__AHZ59882

SEQ ID NO: 147528 - RNA, 1398 nt, Artificial Sequence; identical to SEQ ID NO: 145470
  derived and/or modified sequence opt3 from neuraminidase__InfluenzaA__AHZ59918

SEQ ID NO: 147529 - RNA, 1398 nt, Artificial Sequence; identical to SEQ ID NO: 145470
  derived and/or modified sequence opt3 from neuraminidase__InfluenzaA__AHZ59930

SEQ ID NO: 147530 - RNA, 1398 nt, Artificial Sequence; identical to SEQ ID NO: 145470
  derived and/or modified sequence opt3 from neuraminidase__InfluenzaA__AHZ59942

SEQ ID NO: 147531 - RNA, 1398 nt, Artificial Sequence; identical to SEQ ID NO: 145470
  derived and/or modified sequence opt3 from neuraminidase__InfluenzaA__AHZ59954

SEQ ID NO: 147532 - RNA, 1398 nt, Artificial Sequence; identical to SEQ ID NO: 145470
  derived and/or modified sequence opt3 from neuraminidase__InfluenzaA__AHZ59966

SEQ ID NO: 147533 - RNA, 1398 nt, Artificial Sequence; identical to SEQ ID NO: 145470
  derived and/or modified sequence opt3 from neuraminidase__InfluenzaA__AHZ59991

SEQ ID NO: 147534 - RNA, 1398 nt, Artificial Sequence; identical to SEQ ID NO: 145470
  derived and/or modified sequence opt3 from neuraminidase__InfluenzaA__AHZ60003

SEQ ID NO: 147535 - RNA, 1398 nt, Artificial Sequence; identical to SEQ ID NO: 145470
  derived and/or modified sequence opt3 from neuraminidase__InfluenzaA__AHZ60015

SEQ ID NO: 147536 - RNA, 1398 nt, Artificial Sequence; identical to SEQ ID NO: 145470
  derived and/or modified sequence opt3 from neuraminidase__InfluenzaA__AHZ60027

SEQ ID NO: 147537 - RNA, 1398 nt, Artificial Sequence; identical to SEQ ID NO: 145470
  derived and/or modified sequence opt3 from neuraminidase__InfluenzaA__AHZ60039

SEQ ID NO: 147538 - RNA, 1398 nt, Artificial Sequence; identical to SEQ ID NO: 145470
  derived and/or modified sequence opt3 from neuraminidase__InfluenzaA__AHZ60051

SEQ ID NO: 147539 - RNA, 1398 nt, Artificial Sequence; identical to SEQ ID NO: 145470
  derived and/or modified sequence opt3 from neuraminidase__InfluenzaA__AHZ60063

SEQ ID NO: 147540 - RNA, 1398 nt, Artificial Sequence; identical to SEQ ID NO: 145470
  derived and/or modified sequence opt3 from neuraminidase__InfluenzaA__AHZ60075

SEQ ID NO: 147541 - RNA, 1398 nt, Artificial Sequence; identical to SEQ ID NO: 145470
  derived and/or modified sequence opt3 from neuraminidase__InfluenzaA__AHZ60087

SEQ ID NO: 147542 - RNA, 1398 nt, Artificial Sequence; identical to SEQ ID NO: 145470
  derived and/or modified sequence opt3 from neuraminidase__InfluenzaA__AHZ60099

SEQ ID NO: 147543 - RNA, 1410 nt, Artificial Sequence; identical to SEQ ID NO: 144162
  derived and/or modified sequence opt3 from neuraminidase__InfluenzaA__AHZ60111

SEQ ID NO: 147544 - RNA, 1410 nt, Artificial Sequence; identical to SEQ ID NO: 138418
  derived and/or modified sequence opt3 from neuraminidase__InfluenzaA__AIA26299

SEQ ID NO: 147545 - RNA, 1374 nt, Artificial Sequence
  derived and/or modified sequence opt3 from neuraminidase__InfluenzaA__AIC64891
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccaauuucgcugcaggccagagcguuguguccguaaaacuggccgggaacucuucguugugcccugugucaggaugggcgaucuauagcaaggacaauagugucagaauaggcuccaaaggugauguguuuguuauuagggagccauucaucucuuguagcccguuagaaugccggacauuuuuccugacucagggggcucuacucaacgacaagcauuccaauggaaccauuaaagaucgcucacccuaccgaacacugaugaguuguccuaucggcgaggugccaagccccuauaacucucguuuugaauccgucgccuggucagcaagcgccugccacgacggcaucaauuggcuuaccauugggauaaguggaccugauaacggugcuguggcaguacugaaguacaacggcaucauuacugacacaaucaagucuuggagaaauaacauauugaggacccaggaguccgagugugccugcguuaaugggagcuguuucacggugaugacugauggaccaucgaacggccaggcuucuuauaaaauuuuucggaucgaaaaggguaaaaucgucaaguccguggagaugaaugcccccaacuaccauuaugaagagugcucauguuacccugacaguagcgagauuaccugcgugugccgcgauaauuggcacggguccaacagaccaugggucucuuucaaucaaaaccucgaauaccagaucggauauauuuguagcggcauauuuggcgacaauccgaggcccaacgauaaaacagggucaugcggaccuguuaguuccaauggugcgaacggcgugaagggguucagcuuuaaguacggaaauggcguauggaucggucggacuaaaucuauuucaagucgcaacggguucgagaugaucugggacccaaacggcuggaccggaacagauaauaacuuuagcaucaagcaggacauugugggcauaaaugaaugguccggguauucuggaucguucguccaacaucccgagcugaccggucuggacuguauccgaccuugcuucuggguggaacucauuagaggcaggccaaaagagaacacgaucuggacuagcggguccucaauuaguuuuuguggaguuaauucugauacagugggcuggagcuggcccgacggugcagaguuaccguucaccaucgauaaguga

SEQ ID NO: 147546 - RNA, 1350 nt, Artificial Sequence
  derived and/or modified sequence opt3 from neuraminidase__InfluenzaA__AID48084
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaaucuguugaccgagaaaacaguggcuuccguaaaguuagcaggcaacucuucgcuguguccaaucaaugggugggccguguacucaaaagacaacagcauuagaaucggaaguaagggcgaugucuucgugauuagggaaccguuuaucuccugcucucaucuagaaugucggacuuucuuucucacccagggugcgcugcuuaaugacaagcacagcaacgggacaguuaaagaucgcucaccccaucgaacccugauguccugcccugugggagaggcuccaagucccuauaauagccguuucgaaucugucgccugguccgcaucagccugucacgacggcacuagcugguugacaauaggcauuagugggccugauaacggagcuguggcaguacucaaguacaaugguaucauuaccgacacgaucaaaucuuggagaaacaauauccugaggacucaggaguccgagugcgccuguguuaacggcagcugcuuuaccgugaugacagaugggccaucgaacggacaggcuucucacaagauuuucaaaauggaaaagggcaaggucgugaaauccguggagcuggacgcccccaauuaucauuacgaagaguguucaugcuauccugaugcgggugagauaacuugugucugccgggacaacuggcacgggaguaaucgcccauggguuagcuuuaaccaaaaucucgaauaccagaucggauauauuugcuccggcguguucggcgauaacccgagacccaaugacggggcaggaucuugugguccuguaagcucaaacggcgccuacggggugaagggauuuaguuucaaauacggcaauggugucuggaucgggaggaccaaguccacaaacagccggucuggcuuugagaugauaugggauccaaauggauggaccgaaacggacucaaguuucagcgugaaacaggacauuguugcuaucacugauugguccggcuauucugggucguuugugcagcaucccgaguuaacaggacuggacugcauccgcccuuguuucugggucgaacuuauucgagguagaccaaaggagagcaccaucuggacuuccggcucaaguauuucuuucugcggggugaacagcgauacaguaggaugguccuggcccgacggcgccgaguugccguuuaccauagauaaauga

SEQ ID NO: 147547 - RNA, 1410 nt, Artificial Sequence
  derived and/or modified sequence opt3 from neuraminidase__InfluenzaA__AID70507
augaaccccaaucagaagaucauuaccauaggcagcgugugcacaacuaucgggauggccaaccugauucuccaaaucggaaauauuaucuccauauggaucucucacucaauucagcuugguaaccagaaucagaucgagacguguaaccaaagugucauuaccuacgaaaauaaaacauggguuaaccagacuuaugugaauaucagcaacaccaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggacauuuuuccugacccagggggcucuacucaacgacaaacauucaaauggaacuaucaaggaucgcagucccuaucgaacacugaugagcuguccuauuggcgaggucccaucucccuacaacucccguuuugaaucaguggccuggagcgcaagugccugccacgacggcauaaacuggcuuaccaucgggauuucuggaccugauaauggugcuguagcaguucugaaguauaacggcaucauaacggacacuauuaaauccuggagaaauaacaucuugaggacccaagagagcgagugugccugcgugaaugggucguguuucacagucaugacugauggaccaucugacggccaggcuuccuacaagaucuuucggauugaaaaagguaagaucgugaaaucaguggagaugaacgcccccaauuaucauuacgaagagugcaguuguuacccugauagcuccgagauuaccugcgucugccgcgacaacuggcacgggucuaauagaccauggguuagcuucaaccagaaucucgaauaucagauaggauacaucuguucaggcauuuuuggcgauaacccgaggcccaaugacaagacagggaguugcgauccuguguccuucaacggagcgaaugguguaaagggcuuuagcuucaaauaugggaacggaguguggaucggccggaccaagucuaucucaagucgcaacgguuuugagaugauuugggacccaaauggguggacgggcacugacaacaaauucagcauaaagcaagauaucgucggaauuaaugaaugguccggcuacucugggucguucgugcagcaucccgagcugacaggacuggacuguauccgaccuugcuuuuggguugaacucauuagagguaggccaaaagagaacaccaucuggacuagcggcuccucaauaaguuucuguggggucaauucugauacagugggaugguuuuggcccgacggcgcagaguuaccguucaccaucgauaaguga

SEQ ID NO: 147548 - RNA, 1410 nt, Artificial Sequence
  derived and/or modified sequence opt3 from neuraminidase__InfluenzaA__AID70508
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccuaauaacggugcuguagcaguucugaaguauaauggcaucauaaccgauacgauuaagagcuggagaaacaauaucuugaggacucaagagucggagugugccugcgugaacgggucuuguuucaccaucaugacagacggaccauccgauggccaggcuucauacaaaauuuuucggaucgaaaaggguaaaauugucaagaguguggagaugaaugcccccaacuaucauuacgaagagugcagcuguuacccugacuccucugagauaacuugcgugugccgcgauaauuggcacgggagcaacagaccaugggucucauucaaucagaaccucgaauaucagaucggauacauuuguaguggcaucuuuggcgacaauccgaggcccaacgauaaaaccggguccugcggaccuguuagcucuaauggugcgaacggcgugaagggguucucauuuaaguauggaaacggcguauggaucggucggacaaaaaguauuagcucccgcaagggguucgagaugauaugggacccaaauggcuggaccggaacggauaacaauuuuucuaucaaacaagacauugugggcaucaacgaauggucgggguacagcggauccuucguccagcaucccgagcugacuggucuggacuguauucgaccuugcuucuggguggaacucaucagaggcaggccaaaggagaauacaauauggaccucagggaguucuaucagcuuuuguggaguuaacuccgauacugugggcuggucauggcccgacggugcagaguuaccguucacaauugauaaauga

SEQ ID NO: 147549 - RNA, 1410 nt, Artificial Sequence
  derived and/or modified sequence opt3 from neuraminidase__InfluenzaA__AID70509
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuaacagccgcaagggguucgagaugauaugggauccaaauggcuggaccggaacggacaacaauuuuuccaucaaacaagacauugugggcaucaacgaauggucuggguacucgggaucauucguccagcaucccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 147550 - RNA, 1410 nt, Artificial Sequence
  derived and/or modified sequence opt3 from neuraminidase__InfluenzaA__AID70510
augaaccccaaucagaagaucauuaccauaggcagcgugugcaucacaauugggauggccaaccugauccuccaaauuggaaauaucauauccaucuggauuucucacucaauccagcuugguaaccagagucagauugagacuuguaaucaaagcgucaucacguacgaaaacaauaccuggguuaaccagacauaugugaauauauccaacacuaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggucccaucccccuacaacucacguuuugaaagcguggccuggagugcaucugccugccacgacggcaucaacuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccauuaugacagauggaccauccgacggccaggcuucauacaaaaucuuucggauugaaaaggguaaaauagucaagaguguggagaugaacgcccccaauuaucauuacgaagagugcagcuguuacccugauuccucugagaucacuugcgugugccgcgacaacuggcacgggagcaauagaccaugggucucauucaaccagaaucucgaauaucagauuggauacaucuguaguggcaucuuuggcgauaacccgaggcccaaugacaaaaccggguccugcggaccuguuagcucuaacggugcgaauggcgugaagggguucucauuuaaguauggaaacggcguauggauuggucggacaaaaaguauaagcucccgcaagggguucgagaugaucugggauccaaacggcuggaccggaacggacaauaacuuuucuauuaaacaagacaucgugggcauuaaugaauggucgggguacagcggauccuucguccagcaucccgagcugacuggucuggauuguauccgaccuugcuucuggguggaacucauaagaggcaggccaaaggagaacacaaucuggaccucagggaguucuauuagcuuuuguggaguuaauuccgacacugugggcuggucauggcccgauggugcagaguuaccguucacaaucgacaaauga

SEQ ID NO: 147551 - RNA, 1410 nt, Artificial Sequence
  derived and/or modified sequence opt3 from neuraminidase__InfluenzaA__AID70511
augaaccccaaucagaagaucauuaccaugggcagcguguggaugacaauagggauggccaaccugauccuccaauccggaaauauuaucucuauuuggaucucacacaguauacagcuuagaaaccagagccagaucgagacuugcaaucaauccgucauuacguacgaaaacaauaccuggguuaaccagacauaugugaauaucucuaacacuaauuucgcugcaggucagucgguagugucagucaaacuggccggcaacagcaguuuguguccuguguccgggugggcgauuuacucuaaggacaauagcaucaggauaggauccaaaggcgauguuuuugugauucgggagccauucaucucaugcaguccguuagaaugucgcaccuuuuuccugacacagggugcucuacucaacgacaagcauagcaaugggaccauuaaagaucgaucucccuaucguacucugauguccugcccuaucggagaggucccaucacccuacaacagcagauuugaaaguguggccuggucugcauccgccugucacgacggcaucaacuggcuuacaauuggcauaagcgggccugauaauggagcuguagcaguucugaaguauaacgguaucauuaccgacacgaucaagucguggaggaauaacauauugcggacucaagagucugagugcgccugugugaauggcuccugcuucaccauuaugacagaugggccaucagacggacaggcuaguuacaaaaucuuucgcaucgaaaagggcaaaauugucaagagcguggagaugaacgcccccaauuaucauuacgaagaguguuccugcuacccugauucuagcgagaucacuugugugugcagagacaacuggcacgguucaaauaggccaugggucaguuucaaccagaaucucgaauaucagauuggguacauaugcuccggaaucuuuggcgauaacccgcggcccaaugacaaaaccggcagcugugggccuguuucuucaaacggagcgaauggugugaagggcuucaguuuuaaguaugggaacggaguauggauuggccgcacaaaaagcaucuccucucgaaaggguuucgagaugaucugggauccaaacggguggaccggcacggacaauaacuuuucgauuaaacaagacauagugggaaucaaugaauggagcggcuacuccgggucauucguccagcaucccgagcugacuggacuggauugcauuagaccuuguuucuggguggaacucaucaggggucggccaaaggagaacacaauuuggaccaguggcucuagcaucuccuuuugcgggguuaauucagacacugugggauggagcuggcccgauggcgcagaguuaccguucacaauagacaaauga

SEQ ID NO: 147552 - RNA, 1410 nt, Artificial Sequence
  derived and/or modified sequence opt3 from neuraminidase__InfluenzaA__AID70512
augaaccccaaucagaagaucauuaccauaggcagcguguggaugacaaucgggauggccaaccugauucuccaaaucggaaauauuaucuccauauggaucucucacucaauucagcuugguaaccagagucagaucgagacuugcaaucaaagcgucauuacguacgaaaacaauaccuggguuaaccagacauaugugaauaucuccaacacuaauuucgcugcaggccagucuguagugucggucaaacuggccgggaacagcucauuguguccugugaguggaugggcgauauacuccaaggacaauucuauuagaaucggcagcaaaggugauguuuuugugauuagggagccauucaucuccugcucaccguuagaaugucggaccuuuuuccugacacagggggcucuacucaacgacaagcauaguaauggaaccaucaaagaucgcagccccuaucgaacucugaugucuugcccuauuggcgaggucccaucccccuacaacucacguuuugaaagcguggccuggagugcaucugccugucacgacggcauaaacuggcuuacaaucgggauuuccggaccugauaauggugcuguagcaguucugaaguauaacggcaucauaaccgacacgauuaagagcuggagaaauaacaucuugaggacucaagagucggagugcgccugugugaaugggucuugcuucaccaucaugacagauggaccauccgacggccaggcuucauacaaaauuuuucggaucgaaaaggguaaaauugucaagaguguggagaugaaagcccccaacuaucauuacgaagaguguagcugcuacccugauuccucugagauaacuugugugugccgcgacaauuggcacgggagcaacagaccaugggucucauucaaucagaaccucgaauaucagaucggauacauuugcaguggcaucuuuggcgauaauccgaggcccaacgacaagaccggguccuguggaccuguuagcucuaauggugcgaacggcgugaagggguucucauuuaaauauggaaauggcguauggaucggucggacaaagaguauuagcucccgcaaaggguucgagaugauaugggauccaaacggcuggaccggaacggacaacaauuuuucuaucaagcaagacauuaucggcauuaacgaauggucgggguacagcggauccuucgugcagcaucccgagcugacuggucuggauugcauccgaccuuguuucugggucgaacucauaagaggcaggccaaaagagaauacaaucuggaccucagggaguucuauuagcuuuugcggagugaacuccgacacuguuggcuggucauggcccgauggugcagaguuaccguucacaaucgacaaguga

SEQ ID NO: 147553 - RNA, 1410 nt, Artificial Sequence; identical to SEQ ID NO: 142273
  derived and/or modified sequence opt3 from neuraminidase__InfluenzaA__AID70514

SEQ ID NO: 147554 - RNA, 1410 nt, Artificial Sequence
  derived and/or modified sequence opt3 from neuraminidase__InfluenzaA__AID70515
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaacuugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguauaguaacgggguauggaucggacgcacaaaaagcauuuccucucgaaagggcuucgagaugauaugggauccaaacgguuggaccgggacggacaauaacuuuucgaucaaacaagacauugugggcaucaaugaauggagcggauacuccggcucauucguccagcaucccgagcugacugggcuggauuguauuagaccuugcuucuggguggaacucaucaggggacggccaaaggagaacacaauauggaccagugguucuagcaucuccuuuuguggcguuaauucagacacugugggguggagcuggcccgauggagcagaguuaccguucacaauugacaaauga

SEQ ID NO: 147555 - RNA, 1410 nt, Artificial Sequence; identical to SEQ ID NO: 145174
  derived and/or modified sequence opt3 from neuraminidase__InfluenzaA__AID70516

SEQ ID NO: 147556 - RNA, 1410 nt, Artificial Sequence
  derived and/or modified sequence opt3 from neuraminidase__InfluenzaA__AID70517
augaaccccaaucagaagaucauuaccauaggcagcgugugcaugacaaucgggauggccaaccugacucuccaaauuggaaauaucauuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcgggugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacaaucaugacugauggaccaaaugacggccaggcuucuuacaaaaucuuucggauugaaaaggguaaaaucgucaaguccguggagaugaacgcccccaauuaucauuacgaagagugcucauguuacccugauaguagcgagauuaccugcgugugccgcgacaacuggcacggguccaauagaccaugggucucuuucaaccagaaucucgaauaucagauaggauacaucuguagcggcauuuuuggcgauaacccgaggcccaaugacaaaacagggucaugcggaccuguuaguuccaacggugcgaacggcgugaagggguucagcuuuaaguauggaaauggcguauggaucggucggaccaaaucuaucucaagucgcaagggguucgagaugauuugggauccaaacggcuggacgggaacugacaauaacuuuagcauaaaacaagacaucgugggcauuaaugaaugguccggguacucuggaucguucguccagcaucccgagcugacaggucuggauuguauccgaccuugcuucuggguggaacucauuagaggcaggccaaaggagaacaccaucuggacuagcggguccucaauaaguuuuuguggaguuaauucugacacagugggcuggagcuggcccgauggugcagaguuaccguucaccaucgacaaauga

SEQ ID NO: 147557 - RNA, 1410 nt, Artificial Sequence
  derived and/or modified sequence opt3 from neuraminidase__InfluenzaA__AID70518
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacucauccuugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagagauaccaucccccuacaacucaagauuugaaagcgucgccuggagugcaucugccugccacgacggcaucaacuggcuuacaauuggcaucuccgggccugauaauggagcuguggcaguacugaaguauaacgguauaauuaccgacacgaucaagagcuggaggaauaacaucuugcggacucaagagucggagugugccugcguuaauggcucuuguuucaccauuaugacagaugggccauccgacggacaggcuucauacaaaaucuuucgcauugaaaagggcaaaauagugaagagugucgagaugaacgcccccaauuaucauuacgaagagugcagcuguuacccugauuccucugagaucacuugcgugugcagagacaacuggcacgguagcaauaggccaugggugucauucaaccagaaucucgaauaucagauuggguacaucuguaguggaaucuuuggcgauaacccgcggcccaaugacaaaaccggcuccugcgggccugucagcucuaacggagcgaaugguguuaagggcuucucauuuaaguaugggaacggaguguggauuggccgcacaaaaaguauaagcucccgaaaggguuucgagaugaucugggauccaaacggguggaccggcacggacaauaacuuuucuauuaaacaagacaucguaggaauuaaugaauggucgggcuacagcggguccuucgugcagcaucccgagcugacuggacuggauuguaucagaccuugcuucugggucgaacucauaaggggucggccaaaggagaacacaaucuggaccucaggcaguucuauuagcuuuuguggggugaauagcgacacuguuggauggucauggcccgauggcgcagaguuaccguucacaaucgacaaauga

SEQ ID NO: 147558 - RNA, 1410 nt, Artificial Sequence
  derived and/or modified sequence opt3 from neuraminidase__InfluenzaA__AID70519
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaaagcccccaacuaucauuacgaagagugcagcuguuacccugauuccucugagauaacuugcgugugccgcgacaauuggcacgggagcaacagaccaugggucucauucaaucagaaccucgaauaucagaucggauacauuuguaguggcaucuuuggcgauaauccgaggcccaacgacaagaccggguccugcggaccuguuagcucuaauggugcgaacggcgugaagggguucucauuuaaauauggaaauggcguauggaucggucggacaaagaguauuagcucccgcaaaggguucgagaugauaugggauccaaacggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccaaaagagaauacaauauggaccucagggaguucuaucagcuuuuguggaguuaacuccgacacugugggcuggucauggcccgauggugcagaguuaccguucacaauugacaaguga

SEQ ID NO: 147559 - RNA, 1410 nt, Artificial Sequence
  derived and/or modified sequence opt3 from neuraminidase__InfluenzaA__AID70520
augaaccccaaucagaagaucauuaccauaggcagcgugugcaugacaaucgggauggccaaccugauucuccaaaucggaaauauuaucuccauauggaucucucacucaauucagcuuagaaaccagagucagaucgagacuuguaaucaaagcgucauuacguacgaaaacaauaccuggguuaaccagacauaugugaauaucuccaacacuaauuucgcugcaggucagucuguagugucggucaaacuggccggcaacagcucauugugcccugugagugggugggcgauauacuccaaggacaauucuauuaggaucggaagcaaaggcgauguuuuugugauucgggagccauucaucuccuguucaccguuagaaugccgcaccuuuuuccugacacagggugcucuacucaacgacaagcauaguaaugggaccaucaaagaucgaagccccuaucguacucugaugucuuguccuauuggagaggucccaucccccuacaacucaagauuugaaagcguggccuggagugcaucugccugccacgacggcauaaacuggcuuacaaucggcauuuccgggccugauaauggagcuguagcaguucugaaguauaacgguaucauaaccgacacgauuaagagcuggaggaauaacaucuugcggacucaagagucggagugugccugcgugaauggcucuuguuucaccaucaugacagaugggccauccgacggacaggcuucauacaaaauuuuucgcaucgaaaagggcaaaauugucaagaguguggagaugaacgcccccaauuaucauuacgaagagugcagcuguuacccugauuccucugagauaacuugcgugugcagagacaacuggcacgguagcaauaggccaugggucucauucaaccagaaucucgaauaucagaucggguacauuuguaguggaaucuuuggcgauaacccgcggcccaaugacaaaaccggcuccugcgggccuguuagcucuaacggagcgaauggugugaagggcuucucauuuaaguaugggaacggaguauggaucggccgcacaaaaaguauuagcucccgaaaggguuucgagaugauaugggauccaaacggguggaccggcacggacaauaacuuuucuaucaaacaagacauugugggaaucaaugaauggucgggcuacagcggguccuucguccagcaucccgagcugacuggacuggauuguauuagaccuugcuucuggguggaacucaucaggggucggccaaaggagaacacaauauggaccucaggcaguucuaucagcuuuugugggguuaauuccggaacugugggcuggucauggcccgacggugcagaguuaccguucacaauugauaaauga

SEQ ID NO: 147560 - RNA, 1410 nt, Artificial Sequence
  derived and/or modified sequence opt3 from neuraminidase__InfluenzaA__AID70521
augaaccccaaucagaagaucauuaccauaggcagcgugucccugacaaucucuagaauuugcuucuuuaugcaaaucgccauucucaucaacacugucacgcuucacuucaaacaguacgaguuuaauucaccuccaaacaaucagguuaugcugugugaaccgaccauaaucgagaggaacauuacaaagaucguguauuugacuaauaccacaauugaaaaagagaucugccccaaguuagcugaauaccggaguuggagcaaaccucagugugacauaaccggguucgcaccauuuuccaaggauaacucuauucgccugucggccggaggugacaucuggguaacucgagagcccuaugugucaugcgauccugacaaguguuuccaauuugcgcuaggccaggggacaacccucaauaacguccauagcaaugauacggugcacgaccguacuccauacagaacccugcuuaugaacgagcugggaguucccuuccauuugggcacaaaacaggugugcauugcuuggaguuccucuagcugucacgaugguaaggccuggcuccaugucugcaucacuggggacgauaaaaaugcaaccgccuccaucauuuauaacggaaggcugguggacucaauaguaaguuggagcaagaaaauccugcggacacaggaaucugaguguguuugcauuaauggcaccuguacgguggucaugacugauggcuccgcuucagggaaggcagacacaaagauccucuuuauagaagagggaaaaauugugcacaccagcacuuuaagugguucugcccaacacguggaggaaugcuccugcuacccucgcuauccaggcgucagauguguuugcagggauaacuggaaggggagcaaccggccgaucguggacaucaauauuaaagacuacucgaucguaucuuccuacguguguucaggauucgucggcgauacaccccgcaagccugaccgaaguagcuccucucauugccuggauccaaacaaugaggaaggugggcacggagugaaaggcugggcuuuugacgauggcaacgacguuuggauggggagaaccauuagcgagaagucaaggcuuggauaugaaacguucaaagugauagguggcuggaguaaucccaacuccaagagccagaucaaucggcaggucauuguggaucgugggaaccgcucuggauacucaggcaucuuuaguguagaggguaagagcuguaucaauagaugcuucuauguugaguugauuagggggcggaaagacgaaaccgaggugcuguggacauccaacucuauagucguguucuguggcacuucgggaaccuacggcacagggagcuggccugauggagccgacaucaaucuaaugccaauuuga

SEQ ID NO: 147561 - RNA, 1410 nt, Artificial Sequence
  derived and/or modified sequence opt3 from neuraminidase__InfluenzaA__AID70522
augaaccccaaucagaagaucauuaccauaggcagcgugucccugacaaucucuacuauuugcuucuuuaugcaaaucgccauucucaucacgaccgucacacuucacuucagacaguacgaguuuaacucaccuccaaauaaccagguuaugcugugugaaccgacuauaaucgagaggaauauuaccgaaaucguguauuugacaaacaccacuauugagaaagaaaucugccccaaguuagcugaguaccggaauuggaguaaaccucagugugacauaacaggguucgcaccauuuagcaaggauaacuccauucgccugucugccggaggugacaucuggguaacccgagagcccuaugugucgugcgauccugacaaauguuaccaauucgcgcuaggccaggggacgacucucaauaacguccauucaaauaacaccgugcgugauagaacaccauauaggacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggacggcugguggauuccguaguuucauggaguaaggagauucugcgcacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccauuaaugagacaagcagguugggauaugagacuuuuaaagucaucgaagguuggucaaacccaaagaguaaacugcagauuaaucgacaggugauaguagaccguggcaaccgcuccggguacagcggaaucuucucuguugagggcaagucauguauuaauagaugcuuuuauguggaacuaaucaggggucggaaagaggaaaccgagguccucuggacaaguaacagcaucguggucuucugugggacuuccggcaccuacggaacaggcucuuggcccgauggggccgaccugaaucuuaugccuauuuga

SEQ ID NO: 147562 - RNA, 1410 nt, Artificial Sequence
  derived and/or modified sequence opt3 from neuraminidase__InfluenzaA__AID70523
augaaccccaaucagaagaucaaaaccauuggcagcgugucccugacaaacucuacuauaugcaucuucaugcaaauugccauccucauuacgaccgucacacuucacuuuaagcaguacgaguucaauucaccuccaaacaaucagguuaugcugugugaaccgacuaucauagagagaaacaucaccgaaauuguguauuugacaaauaccacuaucgagaaagaaauuugccccaaguuagcugaguacaggaacuggaguaaaccucagugugacaucacaggguuugcaccauucagcaaggauaauuccauacggcugucugccggaggugacauuuggguaacccgcgagcccuaugugucgugcgauccugacaaguguuaccaauuugcgcuaggccaggggacgacucucaacaauguccauucaaacaauaccgugcgagaucguacaccauauagaacucugcuuaugaacgaacugggaguucccuuccacuugggcaccaaacaggugugcaucgcuuggagcaguuccucuugucaugacgguaaggccuggcuccacgucugcauuacaggggaugacaaaaaugcaaccgccagcuuuaucuacaacggaaggcugguggauuccguaguuucauggaguaaggagauccugcggacgcaggaaagcgagugugugugcauuaacggcacuuguacagucgugaugaccgacggcucugcuuccgggaaagcagauacuaagauacucuucaucgaggaaggaaagauugugcauacaucaaccuuaagcgguagugcccaacacgucgaggaaugcucuugcuauccucgcuacccaggcguuagaugugugugcagggacaauuggaaaggguccaaccggccgaucguagauauaaauauuaaggaccacagcaucgugucgucuuacgucuguuccggacuggugggcgacacgccccgcaaaaacgauucaaguagcuccucucauugccuugacccuaauaacgaggaaggugggcacggaguuaagggcugggcuuuugaugacggcaaugauguguggauggggcgaaccaucaacgagacaagcagauugggauaugagacuuucaaagucauugaagguuggucaaauccaaagaguaaacugcagaucaacaggcaguuuauuguggaccggggcaaucguuccggguacagcggaauauucucuguagagggcaagucauguaucaaccgcugcuuuuauguugaacuaauuagagguaggaaggaggaaaccgaggugcucuggacaaguaauagcaucgucguguucugugggacuuccggcaccuacggaacaggcucuuggcccgauggggccgaccugaaccuuaugccuaucuga

SEQ ID NO: 147563 - RNA, 1410 nt, Artificial Sequence
  derived and/or modified sequence opt3 from neuraminidase__InfluenzaA__AID70524
augaaccccaaucagaagaucauuaccauaggcgccguguggagaacaaucagcacuauuugcuucuuuaugcaaaucgcuuuccugauuacgaccgucacacuccacuuuaaacaguacgaguucaacuccccuccaaauaaccagguuaugccgugugaacccacuaucauagagaggaauaucaccgaaauuguguaucuuacaaacaccacuaucgagaaggaaauuugcccuaaacuggcagaguaccggaauuggucuaagccacagugugacaucacaggguuugcccccuucucaaaagauaacaguauacgcuugagcgcgggaggugacauuuggguaacccgagagccuuauguguccugcgauccagacaaguguuaccaauuugcuuuaggccaggggacgacucugaauaacguccauucuaauaacaccgugcgugauagaacacccuauaggacucuacucaugaaugaacugggaguuccuuuccaccuuggcaccaaacaggugugcaucgccuggucgucaagcaguugucaugacgguaaggcauggcugcacgucugcauuacaggggaugacaagaacgccaccgcuuccuuuaucuacaauggacgguugguggauucuguaguuagcugguccaaagagauccuccgcacgcaggaaucagagugugugugcauuaacggcacuuguacagucgugaugaccgacggcagugcaagcgggaaggccgauacuaaaauacuguucaucgaggaaggaaagauugugcauacaucuacccuguccgguucagcucaacacgucgaggaaugcagcugcuauccaagauacccgggcguuaggugugugugccgggacaacuggaaggggaguaaucgccccaucguagauauaaacauuaaagaccacucuaucguguccagcuacgucuguucgggacucgugggcgacacgccucgaaagaaugauucuuccucaaguagccauugcuuagacccaaacaaugaggaaggugggcacggaguuaaaggcugggccuuugaugacggcaacgauguguggauggggagaaccaucaaugagacauccaggcugggauaugagacuuucaaggucauugaagguuggucuaaccccaaaagcaaacuucagaucaaucgucaggugauuguagaccggggcaaccgcucaggguacaguggaauauuuuccguugagggcaagagcuguaucaauagaugcuucuauguggaauugauuaggggucggaaggaggaaaccgagguccuguggacaucuaacucaaucguggucuucugugggaccaguggcacuuacggaacaggcagcuggccugauggggcggaccuaaaucucaugccaaucuga

SEQ ID NO: 147564 - RNA, 1410 nt, Artificial Sequence
  derived and/or modified sequence opt3 from neuraminidase__InfluenzaA__AID70525
augaaccccaaucagaagaucauuaccauaggcagcgugucccugacaaucuggauuaucugcuucuuuaugcaaauugccauccucauaacuacggucacccuucacuucaaacaguacgaguuuaacucuccuccaaauaaccagguuaugcugugugaaccgacaaucauugagagaaauaucacugaaauuguguauuugaccaacacaaccaucgagaaggaaauaugccccaaauuagcugaguacaggaauuggucaaagccucagugugacauuacuggguucgcaccauuuaguaaagauaacagcauccggcuguccgccggaggugacauuuggguaacacgcgagcccuaugugucuugcgauccugacaaguguuaccaauucgcgcuaggccaggggaccacgcucaauaacguccauucgaauaacacugugcgagaucguaccccauauagaacacugcuuaugaaugaacugggaguucccuuucacuugggcacuaaacaggugugcaucgcuuggucaagcaguuccugucaugacgguaaggccuggcuccacgucugcaucaccggggaugacaagaacgcaacagccucuuucauuuacaauggaaggcugguggauagcguaguuuccuggucaaaagagauacugcggacccaggaaagugagugugugugcaucaacggcacguguacugucgugaugacagacggcagcgcuucugggaaggcagauaccaaaauucucuuuaucgaggaaggaaagauagugcauacuuccacauuaucagguagcgcccaacacgucgaggaaugcaguugcuauccucgcuacccaggcguuagaugugugugcagggacaacuggaaggggucuaaucggccgauuguagauaucaacaucaaagaccacuccauugugagcucguacgucuguucuggacuggugggcgacacccccaggaagaaugauuccucaaguagcucccauugccuugacccuaacaaugaggaaggugggcacggaguuaaaggcugggcuuucgaugacggcaacgauguguggauggggcgaacgaucaaugagaccucuagauugggauaugagacauuuaaggucauugaagguuggagcaacccaaaaucaaagcugcagauaaaucgccaggugaucguagaccggggcaaccguaguggguacuccggaauuuucagcguugagggcaaaucuuguaucaaucgcugcuuuuauguggaacuaaucagagguaggaaggaggaaacugagguccucuggaccucaaacaguauuguggucuucugugggacaagcggcacuuacggaaccggcuccuggcccgauggggccgaccugaauauaaugccuaucuga

SEQ ID NO: 147565 - RNA, 1410 nt, Artificial Sequence; identical to SEQ ID NO: 141534
  derived and/or modified sequence opt3 from neuraminidase__InfluenzaA__AID70526

SEQ ID NO: 147566 - RNA, 1410 nt, Artificial Sequence
  derived and/or modified sequence opt3 from neuraminidase__InfluenzaA__AID70527
augaaccccaaucagaagaucauuaccauaggcagcgugucccugacaauguggaucauuugcuucuuuaugcaaaucgccauucucaucacuacggucacccuucacuucaaacaguacgaguuuaacucuccuccaaauaaccagguuaugcugugugaaccgacaauaaucgagagaaauauuacugaaaucguguauuugaccaacacaaccauugagaaggaaaucugccccaaauuagcugaguacaggaauuggucaaagccucagugugacauaacuggguucgcaccauuuaguaaagauaacagcauucggcuguccgccggaggugacaucuggguaacacgcgagcccuaugugucuugcgauccugacaaguguuaccaauucgcgcuaggccaggggaccacgcucaauaacguccauucgaauaacacugugcgagaucguaccccauauagaacacugcuuaugaaugaacugggaguucccuuucacuugggcacuaaacaggugugcauugcuuggucaagcaguuccugucaugacgguaaggccuggcuccacgucugcaucaccggggaugacaagaacgcaacagccucuuucaucuacaauggaaggcugguggauagcguaguuuccuggucaaaagagauucugcggacccaggaaagugagugugugugcauaaacggcacguguacugucgugaugacagacggcagcgcuucugggaaggcagauaccaaaauccucuuuauugaggaaggaaagaucgugcauacuuccacauuaucagguagcgcccaacacgucgaggaaugcaguugcuauccucgcuacccaggcguuagaugugugugcagggacaacuggaaggggucuaaucggccgauaguagauauuaacaucaaagaccacuccaucgugagcucguacgucuguucuggacuggugggcgacacccccaggaagaaugauuccucaaguagcucccauugccuugacccuaacaaugaggaaggugggcacggaguuaaaggcugggcuuucgaugacggcaacgauguguggauggggcgaacgauuaaugagaccucuagauugggauaugagacauuuaaggucaucgaagguuggagcaacccaaaaucaaagcugcagauuaaucgccaggugauaguagaccggggcaaccguaguggguacuccggaaucuucagcguugagggcaaaucuuguauuaaucgcugcuuuuauguggaacuaaucagagguaggaaggaggaaacugagguccucuggaccucaaacaguaucguggucuucugugggacaagcggcacuuacggaaccggcuccuggcccgauggggccgaccugaaucuuaugccuauuuga

SEQ ID NO: 147567 - RNA, 1410 nt, Artificial Sequence
  derived and/or modified sequence opt3 from neuraminidase__InfluenzaA__AID70528
augaaccccaaucagaagaucauuaccauaggcagcgugucccugucuaucucaacaauuugcuucuuuaugcaaaucgccauucucaucacuacggucacccuucacuucaaacaguacgaguuuaacaguccuccaaauaaccagguuaugcugugugaaccgacaauaaucgagagaaauauuacugaaaucguguauuugaccaacacaaccauugagaaggaaaucugccccaaauuagcugaguacaggaauuggagcaagccucagugugacauaacuggguucgcaccauuuuccaaagauaacucuauucggcugucggccggaggugacaucuggguaacacgcgagcccuaugugucaugcgauccugacaaguguuaccaauucgcgcuaggccaggggaccacgcucaauaacguccauagcaauaacacugugcgagaucguaccccauauagaacacugcuuaugaaugaacugggaguucccuuucacuugggcacuaaacaggugugcauugcuuggaguuccucuagcugucaugacgguaaggccuggcuccacgucugcaucaccggggaugacaagaacgcaacagccuccuucaucuacaauggaaggcugguggauucaguaguuaguuggagcaaagagauucugcggacccaggaaucugagugugugugcauaaacggcacguguacugucgugaugacagacggcuccgcuucagggaaggcagauaccaaaauccucuuuauugaggaaggaaagaucgugcauacuagcacauuaagugguucugcccaacacgucgaggaaugcuccugcuauccucgcuacccaggcguuagaugugugugcagggacaacuggaaggggagcaaucggccgauaguagauauuaacaucaaagaccacucgaucgugucuuccuacgucuguucaggacuggugggcgacacccccaggaagaaugauaguagcuccucuagccauugccuugacccuaacaaugaggaaggugggcacggaguuaaaggcugggcuuucgaugacggcaacgauguguggauggggcgaacgauuaaugagaccucaagauugggauaugagacauuuaaggucaucgaagguuggaguaacccaaaauccaagcugcagauuaaucgccaggugauaguagaccggggcaaccguagcggguacucuggaaucuucucaguugagggcaaaaguuguauuaaucgcugcuuuuauguggaacuaaucagagguaggaaggaggaaacugagguccucuggaccagcaacuccaucguggucuucugugggacaucuggcacuuacggaaccggcucguggcccgauggggccgaccugaaucuuaugccuauuuga

SEQ ID NO: 147568 - RNA, 1410 nt, Artificial Sequence; identical to SEQ ID NO: 141534
  derived and/or modified sequence opt3 from neuraminidase__InfluenzaA__AID70529

SEQ ID NO: 147569 - RNA, 1410 nt, Artificial Sequence
  derived and/or modified sequence opt3 from neuraminidase__InfluenzaA__AID70530
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggucaucgaagguuggucaaacccaaaaaguaagcugcagauuaauaggcaagugauaguagaccggggcaaccguuccggguacagcggaaucuucucuguugagggcaaaucauguauuaaucgcugcuuuuauguggaacuaaucagagguaggaaggaggaaaccgagguccucuggacaaguaacagcaucguggucuucugugggacuuccggcaccuacggaacaggcucuuggcccgauggggccgaccugaauauuaugccuauauga

SEQ ID NO: 147570 - RNA, 1410 nt, Artificial Sequence; identical to SEQ ID NO: 141534
  derived and/or modified sequence opt3 from neuraminidase__InfluenzaA__AID70531

SEQ ID NO: 147571 - RNA, 1410 nt, Artificial Sequence
  derived and/or modified sequence opt3 from neuraminidase__InfluenzaA__AID70532
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacucugaaggucaucgaagguuggucaaacccaaaaaguaagcuacagauuaauaggcaagugauaguagaccggggcaaccguuccggguacuauggaaucuuuagcguugagggcaaaucuuguauuaaucgcugcuucuacguggaacucaucugggguagaaaggaggaaaucgagguccuguggaccucaaacaguaagguggucuuuugugggacaagcggcacuuauggaaccggcuccucucccgauggggccgaccuuaauuucaugccuauuuga

SEQ ID NO: 147572 - RNA, 1410 nt, Artificial Sequence
  derived and/or modified sequence opt3 from neuraminidase__InfluenzaA__AID70533
augaaccccaaucagaagaucauuaccauaggcagcgugucccuggccaucucuacaauuugcuucuuuaugcaaaucgcuauucucaucacuacggucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaauaacacugugcgagaucguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuaaugagaccagcagauugggauaugagacauuuaaggucaucgaagguuggucaaacccaaaaaguaagcugcagauuaaucgccaggugauaguagaccggggcaaccguuccggguacagcggaaucuucucuguugagggcaaaucauguauuaaucgcugcuuuuauguggaacuaaucagagguaggaaggaggaaacugagguccucuggaccaguaacagcaucguggucuucugugggacauccggcacuuacggaaccggcucuuggcccgauggggcggaccugaaucuuaugccuauuuga

SEQ ID NO: 147573 - RNA, 1410 nt, Artificial Sequence
  derived and/or modified sequence opt3 from neuraminidase__InfluenzaA__AID70534
augaaccccaaucagaagaucauuaccauaggcagcgugucccugucuaucuacauuaucugcuucuuuaugcaaauugccauccucauaacaacugucacgcuucacuucaaacaguaugaguuuaacucaccuccaaauaaccaggcuaugccgugugaacccaccaucauugagagaaauaucacagaaauuguuuaccugacuaacaccacaaucgagaaggaaauaugcccuaaauuggcagaguauaggaauuggaguaagccacagugugacauuaccggguucgcccccuuuagcaaagauaacuccauccgguuaucugcgggaggugacauuugggugacucgcgagccuuacguaucgugcgauccagacaaguguuaucaauucgcucugggccaggggacaacccuaaauaacgugcauucaaauaacacgguccgagaucguacucccuacagaacccuccugaugaaugaacuuggagugccuuuucaccugggcacaaagcagguuugcaucgccuggagcaguuccucuugucaugacgguaaagcaugguugcacgugugcaucacuggggaugacaagaacgccaccgcuagcuucauuuauaauggaaggcucgucgauuccgugguaucauggaguaaagagauacugcggacacaggaaagcgaguguguuugcaucaacggcaccuguacgguggucaugacugacggcucugcauccgggaaggccgauacaaaaauucuguuuaucgaggaaggaaagauagugcauaccucaacucucagcgguagugcucaacacguggaggaaugcucuugcuacccacgcuacccgggcgucagauguguuugcagggacaacuggaagggguccaaucggcccauuguggauaucaacaucaaagaccacagcauuguaucgucuuauguguguuccggauuagucggcgacacaccucgcaagaaugauucaaguagcuccucucauugccuggacccaaacaaugaggaaggugggcacggagugaaaggcugggccuucgaugacggcaacgauguuuggauggggcgaaccaucaaugagacgagcagacuuggauacgagaccuuuaaggugauugaagguuggucaaaccccaaaaguaaguugcagauaaauaggcaggucaucguggaccggggcaaccguuccggguauagcggaauuuucucuguagagggcaaaucauguaucaaucgcugcuuuuacguugaacugaucagagguaggaaggaggaaacagaggugcuauggaccaguaacagcauugucguguucugugggacuuccggcacauauggaacuggcucuuggccugauggggcggaccucaaucugaugccaauauga

SEQ ID NO: 147574 - RNA, 1410 nt, Artificial Sequence
  derived and/or modified sequence opt3 from neuraminidase__InfluenzaA__AID70535
augaaccccaaucagaagaucauuaccauaggcagcgugucccuggccaugugcacaaucuguuucuuuaugcaaauugcuauccucauuacuacggucacccuucacuucaaacaguacgaguuuaacucuccuccaaauaaccaggcaaugccgugcgaacccacaaucauagagagaaauaucacugaaauuguuuaucugaccaacacaaccaucgagaaggaaauuuguccuaaauuggccgaguacaggaauuggucaaagccacagugcgacaucacuggguucgcgcccuuuaguaaagauaacagcauacgguuauccgcuggaggugacauuugggugacacgcgagccuuauguaucuugugauccagacaagugcuaccaauucgcccugggccaggggaccacgcuaaauaacgugcauucgaauaacacuguccgagaucguacccccuauagaacacuccugaugaaugaacuuggagugccuuuucaccugggcacuaagcagguuuguaucgcauggucaagcaguuccugccaugacgguaaagccugguugcacguguguauuaccggggaugacaagaacgcuacagcaucuuucaucuacaauggaaggcucgucgauagcgugguauccuggucaaaagagauccugcggacccaggaaagugagugcguuuguauuaacggcacgugcacuguggucaugacagacggcagcgccucugggaaggcugauaccaaaauacuguuuaucgaggaaggaaagauugugcauacuuccacacucucagguagcgcccaacacguggaggaaugcaguuguuauccacgcuacccgggcgucagaugcguuuguagggacaacuggaaggggucuaaucggcccaucguggauauaaacauuaaagaccacuccaucguaagcucguacgugugcucuggauuagucggcgacaccccucgcaagaaugauuccucaaguagcucccauugucuggacccaaacaaugaggaaggugggcacggagugaaaggcugggcguucgaugacggcaacgauguuuggauggggcgaacgaucaaugagaccucuagacuuggauaugagacauuuaaggugauugaagguuggagcaaccccaaaucaaaguugcagaucaauaggcaggucauuguggaccggggcaaccguaguggguacuccggaauauucagcguagagggcaaaucuugcaucaaucgcuguuuuuauguugaacugauuagagguaggaaggaggaaacugaggugcuauggaccucaaacaguaucgucguguucugcgggacaagcggcacuuacggaaccggcuccuggccugauggggcagaccucaaucugaugccaaucuga

SEQ ID NO: 147575 - RNA, 1410 nt, Artificial Sequence
  derived and/or modified sequence opt3 from neuraminidase__InfluenzaA__AID70536
augaaccccaaucagaagaucauuaccauaggcagcgugucccugacaaucucuacugucugcuucuuuaugcaaauugccauccucauuacgaccguuacacuucacuucaaacaguacgaguuuaacucaccuccaaauaaccaggugaugcugugugaaccgacuaucauagacagaaauaucaccgagauuguauauuugacaaacaccacuaucgaaaaggagauuugccccaaauuagcugaauacaggaauuggaguaagccucagugugauaucacaggguucgcaccauuuagcaaagacaacuccauacggcugucugccggaggugauauuugggugacccgcgagcccuaugucucgugcgacccugauaaguguuaccaauucgcgcuaggccaggggacgacucucaauaacgugcauucaaauaacaccguucgagaccguacaccauauagaacucugcuuaugaaugagcugggagugcccuuucacuugggcaccaagcaggucugcaucgcuuggagcaguuccucuugucaugaugguaaagccuggcuccacgugugcauuacaggggacgauaagaacgcaaccgccagcuucaucuacaauggaaggcugguagacuccguugugucauggaguaaagaaauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucaaugaaacaagcagauugggauaugagacuuuuaaggugauugaggguuggucaaacccaaaaaguaagcugcagaucaauaggcagguaauuguugaucggggcaaccguuccggguacagcggaauauucucuguggaaggcaaaucauguaucaaucgcugcuuuuaugucgagcuaauuagagguaggaaggaagagaccgaagugcucuggacaaguaacagcaucgucguguucugugggacuuccggcaccuacggaacaggcucuuggcccgacggggccgaucugaaucuuaugccuaucuga

SEQ ID NO: 147576 - RNA, 1410 nt, Artificial Sequence; identical to SEQ ID NO: 141534
  derived and/or modified sequence opt3 from neuraminidase__InfluenzaA__AID70537

SEQ ID NO: 147577 - RNA, 1410 nt, Artificial Sequence
  derived and/or modified sequence opt3 from neuraminidase__InfluenzaA__AID70538
augaaccccaaucagaagaaaaucaccauuggcgccgugagccugacaaugugcacugucuguauauucaugcaaaucgcuauucucaucacgaccguuacacuucacuuuagacaguacgaguucaacuccccuccaaauaaccaggugaugcugugcgaaccgacuauuaucgagaggaauauaaccgaaaucguauauuugacaaacaccacuauugagaaggaaaucugucccaaauuagcagaguaccggaauuggucuaagccucagugcgacauuacaggguuugccccauucucaaaagauaacaguauccgccugagcgcgggaggugacauaugggugacccgagagcccuaugucuccugugauccugacaagugcuaccaauuugcucuaggccaggggacgacucucaauaacgugcauucuaauaacaccguucgugauagaacaccauauaggacucugcuuaugaaugaacugggagugcccuuccacuugggcaccaagcaggucuguauugccuggucgucaagcaguugccaugacgguaaagcauggcuccacguguguaucacaggggaugacaagaacgccaccgcuuccuuuauuuacaauggacggcugguagauucuguugugagcugguccaaagagauccugcgcacgcaggaaucagagugcgucuguaucaacggcacuugcacaguggugaugaccgacggcagugcaagcgggaaggccgauacuaaaauucucuucauagaggaaggaaagaucguccauacaucuaccuuauccgguucagcucaacacguugaggaaugcagcuguuauccuagauacccaggcgugaggugcguaugucgggacaacuggaaggggaguaaucgcccgauuguggauaucaacauaaaagaccacucuauugucuccagcuacgugugcucgggacugguuggcgacacgccccgaaagaaugauucuuccucaaguagccauugucuugacccuaacaaugaggaaggugggcacggagugaaaggcugggccuuugaugacggcaacgaugucuggauggggagaaccaucaaugagacauccagguugggauaugagacuuucaaggugaucgaagguuggucuaacccaaaaagcaagcugcagauuaaucggcagguaaucguugaccguggcaaccgcucaggguacaguggaauuuuuaguguggagggcaaaagcugcauaaauagauguuucuaugucgaacuaaucaggggucggaaggaggaaaccgaggugcucuggacaucuaacucaauugucguguuuugcgggacuuccggcaccuacggaacaggcagcuggcccgauggggcggaccugaaucuuaugccuaucuga

SEQ ID NO: 147578 - RNA, 1410 nt, Artificial Sequence
  derived and/or modified sequence opt3 from neuraminidase__InfluenzaA__AID70539
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuuaacccuaauaacgaggaaggugggcacggaguuaaaggcugggcuuucgacgauggcaaugacguguggauggggcgaaccauuaacgagacaagcagauugggauaugagacuuuuaaggucaucgaagguuggucaaauccaaaaaguaagcugcagauuaacaggcaagugauaguagaucggggcaaucguuccggguacagcggaaucuucucuguugagggcaaaucauguauuaaccgcugcuuuuauguggaacuaaucagagguaggaaggaggaaaccgagguccucuggacaaguaauagcaucguggucuucugugggacuuccggcaccuacggaacaggcucuuggcccgacggggccgaucugaaccuuaugccuauuuga

SEQ ID NO: 147579 - RNA, 1410 nt, Artificial Sequence; identical to SEQ ID NO: 141534
  derived and/or modified sequence opt3 from neuraminidase__InfluenzaA__AID70540

SEQ ID NO: 147580 - RNA, 1410 nt, Artificial Sequence; identical to SEQ ID NO: 141534
  derived and/or modified sequence opt3 from neuraminidase__InfluenzaA__AID70541

SEQ ID NO: 147581 - RNA, 1410 nt, Artificial Sequence
  derived and/or modified sequence opt3 from neuraminidase__InfluenzaA__AID70633
augaaccccaaucagaagaucauuaccauaggcagcgugugcaugacaaucgggauggccaaccugauucuccaaaucggaaauauuaucuccauaugggucucucacucaauccagcuugguaaccagagucagauugaggcuuguaaucaaagcguuaucacuuacgaaaacaauacgugggugaaccagaccuauguaaauauuuccaacacaaauuucgcagccggccagucuguggucucggugaaacuggcggggaacucaucauugugcccuguuaguggaugggcuaucuacuccaaggacaauucugugagaauaggcagcaaaggugaugucuuugugauuagggagccauucaucuccuguucaccguuagaaugccggaccuuuuuccugacucagggggcccuacucaacgacaagcauaguaauggaacaauuaaagaucgcagccccuaucgaacccugaugucuuguccuaucggcgagguaccaucccccuacaacucacguuuugaaagcguugcauggagugccucugcuugccacgacggcaucaacuggcuuacuauugggauauccggaccugauagcggugcaguggccguccugaaguauaauggcaucauuacagacaccaucaagucguggagaaacaauauauugaggacgcaagagucugagugugcuugcgugaacggguccuguuucacuauuaugaccgauggaccaucagacggccaggccaguuacaaaaucuuucggaucgaaaaggguaaaauugucaagagcguggagaugaaugcgcccaacuaucauuacgaagagugcuccuguuacccugauucuagcgagaucacaugcguuugccgcgacaauuggcacgggucaaacagaccaugggugaguuucaaucagaaccucgaauaucagauuggauacauauguuccggcguauuuggcgauaauccgaggcccaacgacaaaacugggagcugcggaccugugucuucaaauggugcaaacggcgucaagggguucaguuuuaaguauggaaauggcguguggaucggucggaccaaaagcauuuccucucgcaagggguucgagaugaucugggauccaaacggcuggacaggaaccgacaacaaauuuucgaucaagcaagacauuguuggcauaaaugaauggagcggguacuccggaucauucgugcagcaucccgagcugacgggucuggauuguauccgaccuugcuucugggucgaacucauuagaggcaggccagaggagaacacuaucuggacaagugggucuagcauuuccuuuuguggagugaauagcgacaccguaggcuggagcuggcccgauggugccgaauuaccguucacuaucgacaaauga

SEQ ID NO: 147582 - RNA, 1398 nt, Artificial Sequence
  derived and/or modified sequence opt3 from neuraminidase__InfluenzaA__AID70635
augaaccccaagcagaaaauccugugcaccagcgccacagcuauuauaaucggcgcaauugccgugcucaucgggauugcgaaucuuggacugaacaucgguuugcacuuaaagccuggcuguaauugcucccauucucaaccagagacuacgaacaccucacagacaauaaucaauaacuacuauaaugaaacuaacauuaccaauauccagauggaggaaagaacaaguaggaacuucaauaaccugaccaaagggcuauguacuauuaauagcuggcacaucuacggaaaggacaacgcuguccggauaggcgaguccucugauguucucgugacacgcgaaccguauguaucgugcgaccccgaugagugucgauuuuacgcccugucacaggguaccacgauucgugggaaacauagcaauggaacuauccacgacggcagucaauauagagcacuuauuuccuggccucugucuagcccacccaccguguacaacuccagggucgagugcaucggcuggucaaguacaagcugucaugaugggaagucucggauguccaucugcauuucaggaccuaacaauaacgccagcgcugugguuugguauaaucgcagaccaguggcagaaauaaacacuugggccaggaauaucuugcggacccaggagagugaaugugucugccacaacggugugugucccguaguuuucacagacggcucugcuaccgggccugccgauacgcgcauuuacuacuuuaaggagggaaaaauccucaagugggagucccugacuggcacagcgaaacacauagaagagugcagcugcuauggugaacgaaccgggauuacuuguacaugcagagacaauuggcagggaucgaacaggccagugauccagaucgauccggucgcaaugacccauacgucucaauacauuuguucccccgugcugaccgacaauccucggccaaacgaucccaauaucggcaagugcaacgacccuuauccaggcaauaacaauaacggggugaaaggauucucauaccucgauggugccaacacaugguuaggccguacuauuaguaccgcuagccgcuccggguaugagaugcugaagguccccaaugcccuuacagacgacagaucuaagccgauacagggacagacuaucguuuugaacgcagauuggagcggcuacucagguaguuuuauggacuauugggcugaaggggauuguuacagggccugcuucuacguggagcugauucggggccgaccuaaagaggacaagguaugguggaccuccaauagcaucgugucuauguguucaaguacagaauuucuaggacaguggaacuggcccgauggcgcgaaaaucgaguauuuccucuga

SEQ ID NO: 147583 - RNA, 1401 nt, Artificial Sequence
  derived and/or modified sequence opt3 from neuraminidase__InfluenzaA__AIG44695
augaaccccaaucagaagaucaccgccauuggcagcgugucccugauaaucgcuauuaucugccuccuuaugcaaauugcaauccugacaacuacgaugaccuugcacuucagacagaacgaguguucuaauccuucaaacaaucaggucaugccaugcgaaccgauaaucauugagaggaacacaguucauuuaaauaguacuaccaucgaacgggagauuugucccaaaguggccgaauacaagaacuggagcaaaccucagugccaaaucacaggguuugcgccauucuccaaggacaauucuauacgccugucggcuucaggagauauuuggguaacccgagagcccuaugugagcuguagucuagacaaaugcuaccaguuugcccucggucagggcacuacacugaagaacaagcacuccaaugggaccacgcaugaucguacuccucacagaacccuucugaugaacgaguugggagucccauuccaucucggcacaaaacagguguguaucgcauggucuagcuccucaugcuaugacgguaaggccuggcugcacguuugugugacuggggaugacaaaaaugcuaccgcaaguauuaucuacgauggaaugcuggucgacagcgugggcucuugguccaagaacauccucaggacacaagaaucagagugcguauguauuaaugggaccugcgccguugugaugacggauggcagcgcuaguggaaaagccgacacucgggucuuauuuauacgcgaagguaagaucauuaacaucucuccccuguccggcagcgcgcagcacguggaggagugcucguguuauccuagauacccagaagugaggugcgucugucgggauaacuggaaggggucuaaucgcccgauacuuuauauuaacauggcagacuacuccaucgagucaaguuacguuugcagcggauuggugggcgauacaccccgaaaugacgacuccucuagcucaaguaacuguagagauccuaauaacgaaaggggugccccagggguaaaaggaugggcuuucgacgauggcaaugacguguggaugggccggaccaucaagaacgggucccguagcggauaugagacuuuucgcgucgugaaugguuggacaauggccaacucuaaaucacagauuaauagacagguuaucguggauagugacggcuggagcggguacuccggaauuuucucugucgaaggcaagaaaugcauaaacagguguuuuuauguggagcugauccggggucgaccccaagagccucgcguaugguggaccucgaauagcauuaucguuuucugcgggacguccggcaccuacggaacaggcucauggccagauggggcaaacaucaauuuuaugcccauuuga

SEQ ID NO: 147584 - RNA, 1410 nt, Artificial Sequence
  derived and/or modified sequence opt3 from neuraminidase__InfluenzaA__AIJ10793
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuaaugagacaagcagauugggauaugagacuuuuaaggccaucgaagguuggucaaacccaaaaaguaagcugcagaccaauaggcaggucauuguggaccggggcaaccguuccggguacagcggaauauucucuguagagggcaaaucauguaucaaucgcugcuuuuauguugaacuaauuagagguaggaaggaggaaacagaggugcucuggaccaguaacagcaucgucguguucugugggacuuccggcacauacggaaccggcucuuggcccgauggggcggaccugaaucuuaugccuaucuga

SEQ ID NO: 147585 - RNA, 1410 nt, Artificial Sequence; identical to SEQ ID NO: 141534
  derived and/or modified sequence opt3 from neuraminidase__InfluenzaA__AIJ10794

SEQ ID NO: 147586 - RNA, 1410 nt, Artificial Sequence; identical to SEQ ID NO: 143159
  derived and/or modified sequence opt3 from neuraminidase__InfluenzaA__AIJ10795

SEQ ID NO: 147587 - RNA, 1410 nt, Artificial Sequence; identical to SEQ ID NO: 143159
  derived and/or modified sequence opt3 from neuraminidase__InfluenzaA__AIJ10796

SEQ ID NO: 147588 - RNA, 1410 nt, Artificial Sequence
  derived and/or modified sequence opt3 from neuraminidase__InfluenzaA__AIJ10797
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuaaugagacaagccgauugggauaugagacuuuuaaagucaucgaagguuggucaaacccaaagaguaaacugcagauuaauagacaggugauaguagacaggggcaaccgguccggguacagcggaaucuucucuguugaggauaagucauguauuaaucguugcuuuuauguggaacuaauccgcggcagaaaggaggaaaccgagguccucuggacaaguaacagcaucguggucuucugugguacuuccgggaccuacggcacaggaucuuggcccgacggcgccgaucugaaucuuaugccuauuuga

SEQ ID NO: 147589 - RNA, 1410 nt, Artificial Sequence
  derived and/or modified sequence opt3 from neuraminidase__InfluenzaA__AIJ10798
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccacauuagcugaguacaggaauuggaguaaaccucagugugacauaaccggguucgcaccauuuagcaaggauaacuccauucggcugucugccggaggugacaucuggguaacgcgcgagcccuaugugucgugcgauccugacaaauguuaccaauucgcgcuaggccaggggacuacccucaauaacguccauucaaauaacacagugcgagaucguacuccauauagaacccugcuuaugaaugaacugggaguucccuuucacuugggcacaaaacaggugugcauugcuuggagcaguuccucuugucaugacgguaaggccuggcuccacgucugcaucaccggggaugacaagaacgcaacggccagcuucaucuacaauggaaggcugguggauuccguaguuucauggaguaaggagauucugcggacucaggaaagcgagugugugugcauaaacggcacauguaccgucgugaugacugacggcucugcuuccgggaaagcagauacaaagauccucuuuauugaggaaggaaaaaucgugcauaccucaacguuaagcgguagugcccaacacgucgaggaaugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacaauuaaugagacuagcagauugggauaugagaccuuuaaagucaucgaagguuggucaaacccaaagaguaaacugcagauuaaucgccaggugauaguagaccggggcaaccguuccggguacagcggaaucuucucuguugagggcaagucauguauuaaucgcugcuuuuauguggaacuaaucagagguaggaaagaggaaacagagguccucuggaccaguaacagcaucguggucuucugugggacuuccggcacauacggaaccggcucuuggcccgauggggccgaccugaaucuuaugccuauuuga

SEQ ID NO: 147590 - RNA, 1410 nt, Artificial Sequence; identical to SEQ ID NO: 143159
  derived and/or modified sequence opt3 from neuraminidase__InfluenzaA__AIJ10799

SEQ ID NO: 147591 - RNA, 1410 nt, Artificial Sequence
  derived and/or modified sequence opt3 from neuraminidase__InfluenzaA__AIJ10800
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaaacugguggauucaguaguuaguuggagcaaggagauucugaggacgcaggaaucugagugugugugcauaaacggcacuuguacagucgugaugaccgacggcuccgcuucagggaaagcagauacuaagauccucuuuauugaggaaggaaagaucgugcauacaagcaccuuaagugguucugcccaacacgucgaggaaugcuccugcuauccccgguacccuggcguucgcugugugugcagagacaacuggaaagggagcaauaggccaauaguagauauuaacaucaaggaccacucgaucgugucuuccuacgucuguucaggacuggugggcgacacgccgcggaaaaaugauaguagcuccucuagccauugccuugaccccaacaaugaggaaggugggcacggaguuaagggcugggcuuucgaugacggcaacgauguguggauggggcgcaccauuaaugagacaucacgauugggauaugagacuuuuaaagucaucgaagguuggaguaacccuaaguccaaacugcagauuaauagacaggugauaguagacaggggcaaccggagcggguacucuggaaucuucucaguugagggcaagaguuguauuaaucguugcuuuuauguggaacuaauccgcgguagaaaggaggaaaccgagguccucuggacaagcaacuccaucguggucuucugugggacuucuggcaccuacggaacaggcucguggccagauggggccgaccugaaucuuaugcccauuuga

SEQ ID NO: 147592 - RNA, 1410 nt, Artificial Sequence; identical to SEQ ID NO: 144162
  derived and/or modified sequence opt3 from neuraminidase__InfluenzaA__AIJ10801

SEQ ID NO: 147593 - RNA, 1410 nt, Artificial Sequence; identical to SEQ ID NO: 144162
  derived and/or modified sequence opt3 from neuraminidase__InfluenzaA__AIJ10803

SEQ ID NO: 147594 - RNA, 1410 nt, Artificial Sequence; identical to SEQ ID NO: 144162
  derived and/or modified sequence opt3 from neuraminidase__InfluenzaA__AIJ10804

SEQ ID NO: 147595 - RNA, 1410 nt, Artificial Sequence; identical to SEQ ID NO: 144162
  derived and/or modified sequence opt3 from neuraminidase__InfluenzaA__AIJ10805

SEQ ID NO: 147596 - RNA, 1410 nt, Artificial Sequence
  derived and/or modified sequence opt3 from neuraminidase__InfluenzaA__AIJ10806
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcauuucccauugccuggauccaaacaaugaggaagggggacacggcguuaaaggcugggcuuucgacgaugggaacgacguguggaugggacgaaccaucaaugagacaucuagacuugguuaugagacuuuuaaggucauugaaggcuggagcaaccccaaaucaaaguugcagauaaauaggcaagugaucguagaucguggggaccggaguggauacuccggcauuuucagcguugaggguaaaucuuguaucaaccgcugcuuuuauguggaacugaucagagggaggaaggaggaaaccgagguccuauggacaucaaauaguauuguggucuucuguggcacuagcggaaccuacggcacaggguccuggccugauggagccgaccucaaccugaugccaauauga

SEQ ID NO: 147597 - RNA, 1410 nt, Artificial Sequence
  derived and/or modified sequence opt3 from neuraminidase__InfluenzaA__AIJ10807
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgaggcguaugugucgugcgacccugauaaguguuaccaauucgcucuggggcagggaacgacucuaaauaacguccauucaaauaacaccgugcgagaccguacaccauauagaacucuccugaugaaugaacuuggcguucccuuucaccuggguaccaaacaggugugcauugccuggagcaguuccucuugucaugaugggaaggcaugguugcacgucugcaucacaggagacgauaagaacgccaccgcuagcuucaucuacaauggcaggcucguggacuccguaguuucauggaguaaagagauucugcggacgcaggaaagcgagugugugugcauaaacggcacuuguacagucgugaugaccgaugggucugcauccggaaaggccgacacuaaaauccuguuuauugaggaagguaagaucgugcauacaucaacccucagcggcagugcucaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggcuuagugggugacacgccccgcaagaaugacucaaguagcuccucucauugccuggauccuaacaaugaggaagggggacacggcguuaaaggcugggccuucgacgaugggaacgacguguggaugggacgaaccauuaaugagacaagcagacuugguuaugagacuuuuaaggucaucgaaggcuggucaaacccaaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaccgagguccuauggacaaguaauagcaucguggucuucuguggcacuuccggaaccuacggcacagggucuuggcccgauggagcggaccucaaccugaugccuauuuga

SEQ ID NO: 147598 - RNA, 1410 nt, Artificial Sequence
  derived and/or modified sequence opt3 from neuraminidase__InfluenzaA__AIJ10808
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagaggugcugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugaucguggggaccgguccggauacagcggcauauucucuguggaggguaaaucauguaucaaccgcugcuuuuaugucgaacugauuagagggaggaaggaggaaaccgaggugcuauggacaaguaauagcaucgucguguucuguggcacuuccggaaccuacggcacagggucuuggccugauggagccgaccucaaccugaugccaaucuga

SEQ ID NO: 147599 - RNA, 1410 nt, Artificial Sequence; identical to SEQ ID NO: 144162
  derived and/or modified sequence opt3 from neuraminidase__InfluenzaA__AIJ10809

SEQ ID NO: 147600 - RNA, 1410 nt, Artificial Sequence; identical to SEQ ID NO: 144162
  derived and/or modified sequence opt3 from neuraminidase__InfluenzaA__AIJ10810

SEQ ID NO: 147601 - RNA, 1410 nt, Artificial Sequence
  derived and/or modified sequence opt3 from neuraminidase__InfluenzaA__AIJ10812
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaauggagagaaaugugaccgaaaucguauauuugacaaacaccacuauugagaaggaaaucugccccaaaccugcugaguacaggaauuggaguaagccacagugugggauuacaggauucgcacccuuuagcaaagacaacuccauccgguuaucugccgguggcgauauaugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcauugcuuggagcaguuccucuugucaugaugggaaagccugguugcacgugugcaucacaggagacgauaagaacgcaaccgccagcuucauuuacaauggcaggcucguagacuccguugugucauggaguaaagagauccugcggacgcaggaaagcgagugugucugcaucaacggcacuuguacaguggugaugaccgaugggucugcuuccggaaaggcagacacuaaaauucuguuuauagaggaagguaagaucguccauacaucaacccucagcggcagugcccaacacguugaggaaugcucuugcuauccacgcuacccgggggugagauguguaugcagggauaacuggaagggauccaaucggcccauuguggacaucaacauaaaagaucacagcauugucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugaucgaaggcuggucaaaccccaaaaguaaguugcagauuaauaggcagguaaucguugaucguggggaccgguccggauacagcggcauuuucucuguggaggguaaaucauguauaaaccgcugcuuuuaugucgaacugaucagagggaggaaggaggaaaccgaggugcuauggacaaguaauagcauugucguguucuguggcacuuccggaaccuacggcacagggucuuggccugauggagccgaccucaaccugaugccaaucuga

SEQ ID NO: 147602 - RNA, 1410 nt, Artificial Sequence
  derived and/or modified sequence opt3 from neuraminidase__InfluenzaA__AIJ10813
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaauggagagaaaugugaccgaaaucguauauuugacaaacaccacuauugagaaggaaaucugccccaaaccugcugaguacaggaauuggaguaagccacagugugggauuacaggauucgcacccuuuagcaaagacaacuccauccgguuaucugccgguggcgauauaugggugacccgcgagccuuaugucucgugcgacccagauaaguguuaccaauucgcgcuggggcagggaacgacucuaaauaacgugcauucaaauaaccccguucgagaccguaccccuuauagaacacuccugaugaaugaacuuggcgugccauuucaccuggguacuaagcaggucugcauugcuuggagcaguuccucuugucaugaugggaaagccugguugcacgugugcaucaccggagacgauaagaacgcaacagccagcuucauuuacaauggcaggcucguagacuccguugugucauggaguaaagagauccugcggacccaggaaagcgagugugucugcaucaacggcacguguacuguggugaugacagaugggucugcuuccggaaaggcagacaccaaaauucuguuuauagaggaagguaagaucguccauacuucaacacucagcggcagugcccaacacguugaggaaugcucuugcuauccgcgcuaccccggggugagauguguaugcagggauaacuggaagggauccaaucggccuauuguggacaucaacauaaaagaucacagcauugucucgucuuacguguguuccggcuuaguuggugacaccccacgcaagaaugacucaaguagcuccucucauugccuggaucccaacaaugaggaagggggacacggcgugaaaggcugggcuuucgacgaugggaacgacgucuggaugggacgaacgaucaaugagaccagcagacuugguuaugagacauuuaaggugaucgaaggcuggucaaacccuaaaaguaaguugcagauuaauaggcagguaaucguugaucguggggaccgguccggauacagcggcauuuucucuguggaggguaaaucauguauaaaccgcugcuuuuaugucgaacugaucagagggaggaaggaggaaacugaggugcuauggaccaguaauagcauugucguguucuguggcacauccggaacuuacggcaccgggucuuggccagauggagccgaccucaaccugaugcccaucuga

SEQ ID NO: 147603 - RNA, 1410 nt, Artificial Sequence
  derived and/or modified sequence opt3 from neuraminidase__InfluenzaA__AIJ10814
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaguggagagaaauaucaccgaaauuguauauuugacaaacaccacuaucgagaaggaaauuugccccaaaccugcugaguacaggaauuggaguaagccacagugugggaucacaggauucgcacccuuuagcaaagacaacuccauacgguuaucugccgguggcgauauuugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcaucgcuuggagcaguuccucuugucaugaugggaaagccugguugcacgugugcauuacaggagacgauaagaacgcaaccgccagcuucaucuacaauggcaggcucguagacuccguugugucauggaguaaagagauccugcggacgcaggaaagcgagugugucugcauuaacggcacuuguacaguggugaugaccgaugggucugcuuccggaaaggcagacacuaaaauacuguuuaucgaggaagguaagauuguccauacaucaacccucagcggcagugcccaacacguugaggaaugcucuugcuauccacgcuacccgggggugagauguguaugcagggauaacuggaagggauccaaucggcccaucguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaggcagguaauuguugauaaaggggaccgguccggauacagcggcauauucucuguggaggguaagucauguaucaaccguugcuuuuaugucgaacugauucgcgggagaaaggaggaaaccgaggugcuauggacaaguaauagcaucgucguguucuguggcacuuccggaaccuacggcacagggucuuggccugauggagccgaccucaaccugaugccaaucuga

SEQ ID NO: 147604 - RNA, 1410 nt, Artificial Sequence
  derived and/or modified sequence opt3 from neuraminidase__InfluenzaA__AIJ10815
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaucauguauuaaccgcugcuuuuauguggaacugaucagagggaggaaggaggaaaaugagguccuauggaccaguaacagcaucguggucuucuguggcacauccggaacuuacggcaccgggucuuggccugauggagccgaccucaaucugaugccaauuuga

SEQ ID NO: 147605 - RNA, 1410 nt, Artificial Sequence
  derived and/or modified sequence opt3 from neuraminidase__InfluenzaA__AIJ10816
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaggcaagugauaguagaucguggggaccgguccggauacagcggcaucuucucuguugaggguaaaggguguauuaaccgcugcuuuuauguggaacugaucagaggcaggaaggaggaaaccgagguccuauggacaucaaauaguaucguggucuucuguggaacuagcggcaccuacgggacaggauccuggccugauggugccgaccucaaccugaugccaauuuga

SEQ ID NO: 147606 - RNA, 1410 nt, Artificial Sequence; identical to SEQ ID NO: 144162
  derived and/or modified sequence opt3 from neuraminidase__InfluenzaA__AIJ10817

SEQ ID NO: 147607 - RNA, 1410 nt, Artificial Sequence; identical to SEQ ID NO: 144162
  derived and/or modified sequence opt3 from neuraminidase__InfluenzaA__AIJ10818

SEQ ID NO: 147608 - RNA, 1410 nt, Artificial Sequence
  derived and/or modified sequence opt3 from neuraminidase__InfluenzaA__AIJ10819
augaaccccaaucagaagaucauuaccauaggcagcgugucccugacaaucucuacuauuugcuucuuuaugcagaucgccauucucaucacgaccgucgcacuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaaccugcugaguacaggaauuggaguaagccacagugugggauaacuggauucgcccccuuuagcaaagacaacuccauucgguuaucugcggguggcgauaucuggguaacacgcgagccuuaugugucgugcgacccagauaaguguuaccaauucgcucuggggcagggaaccacgcuaaauaacguccauucaaauaacacugugcgagaccguacccccuauagaacacuccugaugaaugaacuuggcguuccuuuucaccuggguacuaaacaggugugcauugccuggagcaguuccucuugucaugaugggaaggcaugguugcacgucugcaucaccggagacgauaagaacgccacagcuagcuucaucuacaauggcaggcucguggacuccguaguuucauggaguaaagagauucugcggacccaggaaagcgagugugugugcauaaacggcacguguacugucgugaugacagaugggucugcauccggaaaggccaacaccaaaauccuguuuauugaggaagguaagaucgugcauacuucaacacucagcggcagugcucaacacgucgaggaaugcucuugcuauccacgcuacccggggguuagaugugugugcagggacaauuggaagggauccaaccggcccauaguagauauuaauaucaaagaccacagcaucgugucgucuuacgucuguuccggcuuagugggugauaccccucgcaagaacgacucaaguagcuccucucauugccuggacccaaauaacgaggaagggggacacggcguuaaaggcugggccuucgaugacgggaaugauguguggaugggacgaacgauuaacgagaccagcagacuugguuaugagacauuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaacugagguccuauggaccaguaacagcaucguggucuucuguggcacauccggaacuuacggcaccgggucuuggccugacggagcggaucucaaucugaugccaauuuga

SEQ ID NO: 147609 - RNA, 1410 nt, Artificial Sequence; identical to SEQ ID NO: 144162
  derived and/or modified sequence opt3 from neuraminidase__InfluenzaA__AIJ10820

SEQ ID NO: 147610 - RNA, 1410 nt, Artificial Sequence; identical to SEQ ID NO: 144162
  derived and/or modified sequence opt3 from neuraminidase__InfluenzaA__AIJ10821

SEQ ID NO: 147611 - RNA, 1410 nt, Artificial Sequence
  derived and/or modified sequence opt3 from neuraminidase__InfluenzaA__AIJ10822
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuguugaagguaaaucauguauuaaccgcugcuuuuauguggagcugaucagagggaggaaggaagagaaugaaguccuauggaccaguaacagcaucguggucuucuguggcacauccggaacuuacggcaccgggucuuggccugacggagccgaucucaaucugaugccaauuuga

SEQ ID NO: 147612 - RNA, 1410 nt, Artificial Sequence
  derived and/or modified sequence opt3 from neuraminidase__InfluenzaA__AIJ10823
augaaccccaaucagaagaucauuaccauaggcagcgugucccugacaaucucuacuauuugcuucuuuaugcaaaucgccauucucaucacgaccgucacacuucacuucaaccaguacgaguuuaauucaccuccaaacaaucagguuaugcugugugaaccgacuauaaucgagagaaacauuaccgaaaucguguauuugacaaccacuacaauugagaaagaaaucugccccaagccugcugaguacaggaauuggaguaaaccacagugugggauaaccggauucgcacccuuuagcaaggacaacuccauucgguuaucugccgguggcgauaucuggguaacgcgcgagccuuaugugucgugcgacccagauaaauguuaccaauucgcgcuggggcagggaacuacccuaaauaacguccauucaaauaacacagugcgagaccguacucccuuuagaacccuccugaugaaugaacuuggcguuccuuuccaccuggguacaaaacaggugugcauugcuuggagcaguuccucuugucaugaugggaaggccugguugcacgucugcaucaccggagacgauaagaacgcaacggccagcuuuaucuauaauggcaggcucguggacuccguaguuucauggaguaaggagauucugcggacucaggaaagcgagugugugugcauaaacggcacauguaccgucgugaugacugaugggucugcuuccggaaaagcagugacaaagauccuguucauugaggaagguaaaaucguccauaccucaacgcucagcggcagugcccaacacguugaggaaugcucuugcuacccacgcuauccgggggugagauguguaugcagggacaacuggaagggauccaaucggcccauaguggauauuaacaucaaggaccacagcaucgucucgggcuacguguguucugguuuaguuggggauaccccucgcaaaaaugacuccucaaguagcucccauugccugaacccaaauaacgaggaaggaggccacggcgugaaggggugggcuuuugacgauggaaaugacgucuggaugggucgaacaauuaacgagacuucuagacuuggcuacgagaccuucaaagugaucgaaggguggagcaaucccaagucaaaauugcagauuaacaggcagguaauaguugaucggggagaccguaguggcuauuccgguaucuuuagcguggaggggaagucuuguauuaaucgcugcuucuacgucgaacugaucagaggcaggaaagaggaaacagaggugcuauggacuucaaacaguaucgucguguucuguggaaccagcggcacauaugggaccggauccuggccugauggugccgaccucaaucugaugccaauuuga

SEQ ID NO: 147613 - RNA, 1410 nt, Artificial Sequence
  derived and/or modified sequence opt3 from neuraminidase__InfluenzaA__AIJ10824
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuaugucucgugcgacccagauaaguguuaccaauucgcgcuggggcagggaacgacucuaaauaacgugcauucaaauaacaccguucgagaccguacacccuauagaacucuccugaugaaugaacuuggcgugccuuuucaccuggguaccaagcaggucugcauugcuuggagcaguuccucuugucaugaugggaaagccugguugcacgugugcaucacaggagacgauaagaacgcaaccgccagcuucaucuacaauggcaggcucguagacuccguugugucauggaguaaagagauucugcggacgcaggaaagcgagugugucugcauaaacggcacuuguacaguggugaugaccgaugggucugcuuccggaaaggcagacacuaaaauccuguuuauugaggaagguaagaucguccauacaucaacccucagcggcagugcccaacacguugaggaaugcucuugcuauccacgcuacccgggggugagauguguaugcagggauaacuggaagggauccaaucggcccauaguggacauuaacaucaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccauuaaugagacaagcagacuugguuaugagacuuuuaaggugaucgaaggcuggucaaaccccaaaaguaaguugcagauuaauaggcagguaauaguugaucguggggaccgguccggauacagcggcaucuucucuguggaggguaaaucauguauuaaccgcugcuuuuaugucgaacugaucagagggaggaaggaggaaaccgaggugcuauggacaaguaauagcaucgucguguucuguggcacuuccggaaccuacggcacagggucuuggccugauggagccgaccucaaccugaugccaauuuga

SEQ ID NO: 147614 - RNA, 1410 nt, Artificial Sequence
  derived and/or modified sequence opt3 from neuraminidase__InfluenzaA__AIJ10827
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuauugaagguaaaucauguaucaaccgcugcuuuuauguugagcugaucagagggaggaaggaagagaccgaagugcuauggacaaguaauagcauugucguguucuguggcacuuccggaaccuacggcacagggucuuggccugacggagccgaucucaaccugaugccaauauga

SEQ ID NO: 147615 - RNA, 1410 nt, Artificial Sequence
  derived and/or modified sequence opt3 from neuraminidase__InfluenzaA__AIJ10828
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuauugaagguaaaucauguaucaaccgcugcuuuuauguugagcugaucagagggaggaaggaagagaccgaaguggucuggacaaguaauagcauuguggucuucuguggcacuuccggaaccuacggcacagggucuuggccugacggagccgaucuaaaccucaugccaauauga

SEQ ID NO: 147616 - RNA, 1410 nt, Artificial Sequence
  derived and/or modified sequence opt3 from neuraminidase__InfluenzaA__AIJ10829
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaauuguuaccaauucgcgcuggggcagggaacgacucuaaacaauguccauucaaacaauaccgugcgagaccguacacccuauagaacucuccugaugaacgaacuuggcguuccuuuucaccuggguaccaaacaggugugcauugcuuggagcaguuccucuugucaugaugggaaggccugguugcacgucugcaucacaggagacgauaagaaugcaaccgccagcuucaucuacaacggcaggcucguggacuccguaguuucauggaguaaggauauucugcggacgcaggagagcgaaugugugugcauaaacggcacuuguacagucgugaugaccgacgggucugcuuccggaaaagcagauacuaagauccuguuuauugaggaggguaaaaucgugcauacaucaacccucagcggcagugcccaacacgucgaagagugcucuugcuauccacgcuacccggggguuagaugugugugcagggacaauuggaagggauccaaccggcccauaguagauauuaauaucaaggaccacagcaucgugucgucuuacgucuguuccggcuuagugggugacacgccucgcaaaaacgauucaaguagcuccucucauugccuggacccaaauaacgaagagggggaucacggaguuaagggcugggcuuucgacgauggcaaugacguguggauggggcgaaccauuaacgaaacaagcagacuuggauaugagacuuuuaaagucaucgaggguuggucaaaucccaagaguaaauugcagauuaacaggcaagugauaguagaucggggcgaccguuccggguacagcggaaucuucucuauugaaggcaagucauguaucaaucgcugcuuuuauguugagcugaucagagguaggaaagaagagaccgaagugcuauggacaaguaacagcauugucguguucugugggacuuccggcaccuacggaacaggcucuuggccugauggggccgaccucaaucugaugccaauauga

SEQ ID NO: 147617 - RNA, 1410 nt, Artificial Sequence
  derived and/or modified sequence opt3 from neuraminidase__InfluenzaA__AIJ10830
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaagaauuggaguaaaccacagugugggauaacaggauucgcacccuuuagcaaggacaacuccauuagguuaucugccgguggcgauaucuggguaacccgggagccuuaugugucgugcgacccagauaaguguuaccaauucgcgcuggggcagggaacgacucuaaauaacguccauucaaauaacaccgugcgcgaccgaacacccuaucguacucuccugaugaaugaacuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcagacucguggacuccguaguuucauggaguaaggauauucugaggacgcaggagagcgaaugugugugcauaaacggcacuuguacagucgugaugaccgacgggucugcuuccggaaaagcagauacuaagauccuguuuauugaggaggguaagaucgugcauacaucaacccucagcggcagugcccaacacgucgaagagugcucuugcuauccacgguacccggggguucgcugugugugcagagacaacuggaaaggauccaauaggcccauaguagauauuaacaucaaggaccacagcaucgugucgucuuacgucuguuccggcuuagugggugacacgccucggaaaaaugauucaaguagcuccucucauugccuggacccaaacaaugaagaagggggacacggcguuaagggcugggcuuucgaugacgggaacgauguguggaugggacgcaccauuaaugagacaagccgacuugguuaugagacuuuuaaagucaucgagggcuggucaaaccccaagaguaaauugcagauuaauagacaggugauaguagacaggggagaucgguccggguacagcggcaucuucucuauugaagguaagucauguaucaaccguugcuuuuauguugagcugauccgcgggagaaaggaagagaccgaagugcuauggacaaguaauagcauugucguguucuguggcacuuccggaaccuacggcacagggucuuggccugacggagccgaucucaaccugaugccaauauga

SEQ ID NO: 147618 - RNA, 1410 nt, Artificial Sequence; identical to SEQ ID NO: 147614
  derived and/or modified sequence opt3 from neuraminidase__InfluenzaA__AIJ10831

SEQ ID NO: 147619 - RNA, 1410 nt, Artificial Sequence; identical to SEQ ID NO: 147614
  derived and/or modified sequence opt3 from neuraminidase__InfluenzaA__AIJ10832

SEQ ID NO: 147620 - RNA, 1410 nt, Artificial Sequence
  derived and/or modified sequence opt3 from neuraminidase__InfluenzaA__AIJ10834
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuauugaaucaaaaaguuguaucaaccgcugcuuuuauguugagcugaucagagguaggaaggaagagaccgaagugcuauggacaagcaauuccauugucguguucugugggacuucuggcaccuacggaacaggcucguggccugacggggccgaucucaaccugaugccaauauga

SEQ ID NO: 147621 - RNA, 1410 nt, Artificial Sequence
  derived and/or modified sequence opt3 from neuraminidase__InfluenzaA__AIJ10835
augaaccccaaucagaagaucauuaccauaggcagcgugucccugacaaucucuacuauuugcuucuuuaugcaaaucgccauucucaucacgaccgucacacuucacuucaaacaguacgaguuuaacucaacuccuaauaaccagguuaugcugugugaaccaaccauaaucgagagaaauauuacagaaaucguguauuugaccaacacuacaauugagaaggaaaucugcccgaaacccgcugaguacaggaauuggaguaagccucagugugggauaaccggauucgcaccauuuagcaaagacaacuccauucgguuaucugccgguggcgauaucuggguaacgcgcgagcccuaugugucgugcgacccugauaaguguuaccaauucgcgcuggggcagggaacuacccuaaauaacguccauucaaauaacacagugcgagaccguacuccauauagaacccuccugaugaaugaacuuggcguucccuuucaccuggguacaaaacaggugugcauugcuuggagcaguuccucuugucaugaugggaaggccugguugcacgucugcaucaccggagacgauaagaacgcaacggccagcuucaucuacaauggcaggcucguggacuccguaguuucauggaguaaagauauucugcggacucaggagagcgaaugugugugcauaaacggcacauguaccgucgugaugacugacgggucugcuuccggaaaggcagauacaaaaauccuguuuauugaggaggguaagaucgugcauaccucaacgcucagcggcagugcccaacacgucgaagagugcucuugcuauccucgcuacccagggguuagaugugugugcagggacaacuggaagggauccaaucggccgauaguagauauuaacaucaaagaccacagcaucgugucgucuuacgucuguuccggcuuagugggugacacccccaggaagaaugauucaaguagcuccucucauugccuggacccuaacaaugaagaagggggacacggcguuaaaggcugggcuuucgaugacgggaacgauguguggaugggacgaacaauuaaugagacuagcagacuugguuaugagaccuuuaaggucaucgagggcuggucaaacccaaaaaguaaguugcagauuaaucgccaggugauaguagaccguggggaucgguccggauacagcggcaucuucucuauugaagguaaaucauguaucaaccgcugcuuuuauguugagcugaucagagggaggaaggaagagacagaagugcuauggaccaguaauagcauugucguguucuguggcacuuccggaacauacggcaccgggucuuggcccgacggagccgaucucaaccugaugccuauauga

SEQ ID NO: 147622 - RNA, 1410 nt, Artificial Sequence; identical to SEQ ID NO: 147614
  derived and/or modified sequence opt3 from neuraminidase__InfluenzaA__AIJ10836

SEQ ID NO: 147623 - RNA, 1410 nt, Artificial Sequence
  derived and/or modified sequence opt3 from neuraminidase__InfluenzaA__AIJ10837
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucauacauacaucaacccucagcggcagugcccaacacguggaagagugcucuugcuauccacgcuacccgggggucagauguguuugcagggacaacuggaagggauccaaucggcccauuguggauaucaacaucaaagaccacagcauuguaucgucuuacguguguuccggcuuagucggugacacgccucgcaagaaugauucaaguagcuccucucauugccuggacccaaacaaugaagaagggggacacggcgugaaaggcugggcuuucgaugacgggaacgauguuuggaugggacgaaccaucaaugagacaagcagacuugguuaugagacuuuuaaggugauugagggcuggucaaaccccaaaaguaaguugcagauaaauaggcaggucaucguggaccguggggaucgguccggauacagcggcauuuucucuaucgaagguaaaucauguaucaaccgcugcuuuuauguagagcugauuagagggaggaaggaagagaccgaaguucuauggacaaguaauagcauaguggucuucuguggcacuuccggaaccuacggcacagggucuuggccugacggagccgaucucaaccugaugccaaucuga

SEQ ID NO: 147624 - RNA, 1410 nt, Artificial Sequence; identical to SEQ ID NO: 147614
  derived and/or modified sequence opt3 from neuraminidase__InfluenzaA__AIJ10838

SEQ ID NO: 147625 - RNA, 1410 nt, Artificial Sequence
  derived and/or modified sequence opt3 from neuraminidase__InfluenzaA__AIJ10841
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggagaggcagauacuaagauccuguuuauugaggaagguaaaaucgugcauacaucaacccucagcggcagugcccaacacgucgaggaaugcucuugcuauccacgcuacccggggguuagaugugugugcagggacaacuggaagggauccaaucggcccauaguagauauuaacaucaaggaccacagcaucgugucgucuuacgucuguuccggcuuagugggugacacgccucgcaaaaaugauucaaguagcuccucucauugccuggacccaaacaaugaggaagggggacacggcguuaagggcugggcuuucgaugacgggaacgauguguggaugggacgaaccauuaaugagacaagcagacuugguuaugagacuuuuaaagucaucgaaggcuggucaaaccccaagaguaaauugcagauuaauaggcaagugauaguagaccguggggaucgguccggauacagcggcaucuucucuauugaggguaagucauguaucaaccgcugcuuuuauguugaacugaucagagggaggaaagaggaaaccgaggugcuauggacaaguaauagcauugucguguucuguggcacuuccggaaccuacggcacagggucuuggccugacggagccgaucucaaccugaugccaauauga

SEQ ID NO: 147626 - RNA, 1410 nt, Artificial Sequence
  derived and/or modified sequence opt3 from neuraminidase__InfluenzaA__AIJ10842
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaaccagcugaguacaggaauuggucaaagccccagugugggauaacaggauucgcaccuuuuaguaaagacaacagcauucgguuauccgccgguggcgauaucuggguaacccgcgagccauaugugucuugcgaccccgauaaguguuaccaauucgcgcuggggcagggaacgacucuaaauaacguccauucgaauaacaccgugcgagaccguacaccuuauagaacucuccugaugaaugaacuuggcguuccauuucaccuggguaccaaacaggugugcauugcuuggucaagcaguuccugucaugaugggaaggccugguugcacgucugcaucacaggagacgauaagaacgcaaccgccucuuucaucuacaauggcaggcucguggacagcguaguuuccuggucaaaagauauucugcggacgcaggagagugaaugugugugcauaaacggcacuuguacagucgugaugaccgacgggagcgcuucuggaaaggcagauacuaaaauccuguuuauugaggaggguaagaucgugcauacauccacccucucaggcagcgcccaacacgucgaagagugcaguugcuauccgcgcuaccccgggguuagaugugugugcagggacaacuggaagggaucuaaucggccuauaguagauauuaacaucaaagaccacuccaucgugagcucguacgucuguucuggcuuagugggugacacgccacgcaagaaugauuccucaaguagcucccauugccuggaccccaacaaugaagaagggggacacggcguuaaaggcugggcuuucgaugacgggaacgauguguggaugggacgaaccauuaaugagacaucuagacuugguuaugagacuuuuaaggucaucgagggcuggagcaacccuaaaucaaaguugcagauuaauaggcaagugauaguagaccguggggaucggaguggauacuccggcaucuucagcauugaagguaaaucuuguaucaaccgcugcuuuuauguugagcugaucagagggaggaaggaagagaccgaagugcuauggacaucaaauaguauugucguguucuguggcacuagcggaaccuacggcacaggguccuggccagacggagccgaucucaaccugaugcccauauga

SEQ ID NO: 147627 - RNA, 1410 nt, Artificial Sequence; identical to SEQ ID NO: 147614
  derived and/or modified sequence opt3 from neuraminidase__InfluenzaA__AIJ10843

SEQ ID NO: 147628 - RNA, 1410 nt, Artificial Sequence
  derived and/or modified sequence opt3 from neuraminidase__InfluenzaA__AIJ10844
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuuuagaacucuccugaugaaugaacuuggcguuccuuuccaccuggguaccaaacaggugugcauugcuuggagcaguuccucuugucaugaugggaaggccugguugcacgucugcaucacaggagacgauaagaacgcaaccgccagcuuuaucuauaauggcaggcucguggacuccguaguuucauggaguaaagagauucugcggacgcaggaaagcgagugugugugcauaaacggcacuuguacagucgugaugaccgaugggucugcuuccggaaaggcagugacuaaaauccuguucauugaggaagguaagaucguccauacaucaacccucagcggcagugcccaacacguugaggaaugcucuugcuacccacgcuauccgggggugagauguguaugcagggacaacuggaagggauccaaucggcccauaguggauauuaacaucaaagaccacagcaucgucucgggcuacguguguucugguuuaguuggggauacgccucgcaagaaugacuccucaaguagcggacauugccuggacccaaacaaugaggaaggcggccacggggugaaaggaugggcuuuugaugacgguaacgaugucuggaugggccgaaccauuaaugagacauccagacuuggguacgagacuuucaaggugaucaaaggauggucuaaccccaagagcaaauugcagauuaauaggcagguaauaguugaccggggcgaucguucagguuauagugggaucuuuuccguggaaggcaagagcuguauuaaccgcugcuucuacgucgagcugaucagaggaaggaaggaagagaccgaagugcuauggacaucuaauucaaucgucguguucuguggcaccagugggacuuauggaacagguagcuggccugacggcgccgaucucaaccugaugccaauuuga

SEQ ID NO: 147629 - RNA, 1410 nt, Artificial Sequence
  derived and/or modified sequence opt3 from neuraminidase__InfluenzaA__AIJ10845
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccauuaucgagaaggaaauaugccccaaaccugcugaguacaggaauuggaguaagccacagugugggauuacuggauucgcacccuuuagcaaagacaacuccauccgguuaucugccgguggcgauauuuggguaacacgcgagccuuaugugucgugcgacccagauaaguguuaccaauucgcgcuggggcagggaaccacgcuaaauaacguccauucaaauaacacugugcgagaccguacccccuuuagaacacuccugaugaaugaacuuggcguuccuuuccaccuggguacuaaacaggugugcaucgcuuggagcaguuccucuugucaugaugggaaggccugguugcacgucugcaucaccggagacgauaagaacgcaacagccagcuuuauuuauaauggcaggcucguggacuccguaguuucauggaguaaagagauacugcggacccaggaaagcgagugugugugcaucaacggcacguguacugucgugaugacagaugggucugcuuccggaaaggcagugaccaaaauucuguucaucgaggaagguaagauaguccauacuucaacacucagcggcagugcccaacacguugaggaaugcucuugcuacccacgcuauccgggggugagauguguaugcagggacaacuggaagggauccaaucggcccauuguggauaucaacaucaaagaccacagcauugucucgggcuacguguguucugguuuaguuggggauaccccucgcaagaaugacuccucaaguagcucccauugccuggacccaaacaaugaggaaggaggccacggcgugaaagggugggcuuuugaugacggaaacgaugucuggaugggucgaacgaucaaugagaccucuagacuuggcuacgagacauucaaggugauugaaggguggagcaaccccaaaucaaaguugcagauaaauaggcagguaaucguugaccggggagaucguaguggcuauuccgguauuuuuagcguggaggggaaaucuuguaucaaccgcugcuucuacgucgaacugaucagaggcaggaaggaggaaacugaggugcuauggaccucaaauaguauugucguguucuguggaacaagcggcacuuaugggaccggauccuggccugacggugccgaucucaaccugaugccaauauga

SEQ ID NO: 147630 - RNA, 1410 nt, Artificial Sequence
  derived and/or modified sequence opt3 from neuraminidase__InfluenzaA__AIJ10847
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucauucaguagcucccauugccuggacccaaacaaugaagaagggggacacggcguuaaaggcugggcuuuugaugacgggaacgauguguggaugggacgaaccauuaaugagacaucuagacuugguuaugagacuuucaaggucaucgagggcuggagcaaccccaaaucaaaguugcagauuaauaggcaagugauaguagaccguggggaucggaguggauacuccggcaucuuuagcauugaagguaaaucuuguaucaaccgcugcuucuauguugagcugaucagagggaggaaggaagagaccgaagugcuauggacaucaaauaguauugucguguucuguggcacuagcggaaccuacggcacaggguccuggccugacggagccgaucucaaccugaugccaauauga

SEQ ID NO: 147631 - RNA, 1410 nt, Artificial Sequence; identical to SEQ ID NO: 147614
  derived and/or modified sequence opt3 from neuraminidase__InfluenzaA__AIJ10848

SEQ ID NO: 147632 - RNA, 1410 nt, Artificial Sequence
  derived and/or modified sequence opt3 from neuraminidase__InfluenzaA__AIJ10849
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuuuagaacucuccugaugaaugaacuuggcguuccuuuccaccuggguaccaaacaggugugcauugcuuggagcaguuccucuugucaugaugggaaggccugguugcacgucugcaucacaggagacgauaagaacgcaaccgccagcuuuaucuauaauggcaggcucguggacuccguaguuucauggaguaaagagauucugcggacgcaggaaagcgagugugugugcauaaacggcacuuguacagucgugaugaccgaugggucugcuuccggaaaggcagugacuaaaauccuguucauugaggaagguaagaucguccauacaucaacccucagcggcagugcccaacacguugaggaaugcucuugcuacccacgcuauccgggggugagauguguaugcagggacaacuggaagggauccaaucggcccauaguggauauuaacaucaaagaccacagcaucgucucgggcuacguguguucugguuuaguuggggauacgccucgcaagaaugacuccucaaguagcucccauugccuggacccaaacaaugaggaaggaggccacggcgugaaagggugggcuuuugaugacggaaacgaugucuggaugggucgaaccauuaaugagacaucuagacuuggcuacgagacuuucaaggugaucgaaggguggagcaaccccaaaucaaaguugcagauuaauaggcagguaauaguugaccggggagaucguaguggcuauuccgguaucuuuagcguggaggggaaaucuuguauuaaccgcugcuucuacgucgaacugaucagaggcaggaaggaggaaaccgaggugcuauggacaucaaauaguaucgucguguucuguggaacuagcggcaccuaugggacaggauccuggccugacggugccgaucucaaccugaugccaauuuga

SEQ ID NO: 147633 - RNA, 1410 nt, Artificial Sequence; identical to SEQ ID NO: 147632
  derived and/or modified sequence opt3 from neuraminidase__InfluenzaA__AIJ10851

SEQ ID NO: 147634 - RNA, 1410 nt, Artificial Sequence; identical to SEQ ID NO: 147632
  derived and/or modified sequence opt3 from neuraminidase__InfluenzaA__AIJ10852

SEQ ID NO: 147635 - RNA, 1410 nt, Artificial Sequence; identical to SEQ ID NO: 147628
  derived and/or modified sequence opt3 from neuraminidase__InfluenzaA__AIJ10853

SEQ ID NO: 147636 - RNA, 1410 nt, Artificial Sequence; identical to SEQ ID NO: 147628
  derived and/or modified sequence opt3 from neuraminidase__InfluenzaA__AIJ10854

SEQ ID NO: 147637 - RNA, 1410 nt, Artificial Sequence
  derived and/or modified sequence opt3 from neuraminidase__InfluenzaA__AIJ10855
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuuuagaacucuccugaugaaugaacuuggcguuccuuuccaccuggguaccaaacaggugugcauugcuuggagcaguuccucuugucaugaugggaaggccugguugcacgucugcaucacaggagacgauaagaacgcaaccgccagcuuuaucuauaauggcaggcucguggacuccguaguuucauggaguaaagagauucugcggacgcaggaaagcgagugugugugcauaaacggcacuuguacagucgugaugaccgaugggucugcuuccggaaaggcagugacuaaaauccuguucauugaggaagguaagaucguccauacaucaacccucagcggcagugcccaacacguugaggaaugcucuugcuacccacgcuauccgggggugagauguguaugcagggacaacuggaagggauccaaucggcccauaguggauauuaacaucaaagaccacagcaucgucucgggcuacguguguucugguuuaguuggggauacgccucgcaagaaugacuccucaaguagcucccauugccuggacccaaacaaugaggaaggagaucacggcgugaaaggcugggcuuuugacgaugggaacgacgucuggaugggacgaaccauuaaugagacaucuagacuugguuacgagacuuucaaggugaucgaaggcuggagcaaccccaaaucaaaguugcagauuaauaggcagguaauaguugaucguggggaccggaguggauauuccggcaucuuuagcguggaggguaaaucuuguauuaaccgcugcuucuacgucgaacugaucagagggaggaaggaggaaaccgaggugcuauggacaucaaauaguaucgucguguucuguggcacuagcggaaccuauggcacaggguccuggccugauggagccgaccucaaccugaugccaauuuga

SEQ ID NO: 147638 - RNA, 1410 nt, Artificial Sequence
  derived and/or modified sequence opt3 from neuraminidase__InfluenzaA__AIJ10856
augaaccccaauaagaaaaucauuaccauaggcagcgugucccugacaaucucuacuauuugcuucuuuaugcagaucgccauucucaucacgaccgucacacuucacuucaagcaguacgaguuuaacucaccuccaaauaaccagguuaugcugugugaaccgacuauaaucgagagaaauauuaccgaaaucguguauuugacaaacaccacuauugagaaagaaaucugccccaagccugcugaguacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaguucgcgcuggggcaaggaacgacucuaaagaauguccauucaaacaauaccgugcgagaccguacacccuauagaacucuccugaugaacgaacuuggcguuccuuuucaccuggguaccaaacaggugugcauugcuuggagcaguuccucuugucaugaugggaaagccugguugcacgucugcaucacaggagacgauaagaaugcaaccgccagcuucaucuacaacggcaggcucguggacuccguaguuucauggaguaaagauauucugcggacgcaggagagcgaaugugugugcauaaauggcacuuguacagucgugaugaccgacgggucugcuuccggaaaggcagauacuaagauccuguuuauugaggaggguaaaaucgugcauacaucaacccucagcggcagugcccagcacgucgaagagugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucauucaguagcgggcauugccuggacccaaauaacgaagagggaggccacggcguuaaagggugggcuuuugaugacggaaaugauguguggaugggucgaaccauuaacgaaacauccagacuuggcuaugagacuuucaaggucaucgagggguggucuaaucccaaaagcaaguugcaaauuaacaggcaagugauaguagaccggggagaucguucaggcuacagugguaucuuuuccauugaagggaagaguuguaucaaucgcugcuucuauguugagcugaucagaggcaggaaagaagagaccgaagugcuauggacaucuaacucaauugucguguucuguggaacuagcggcaccuacgggacaggaagcuggccugacggugccgaucucaaucugaugccaauauga

SEQ ID NO: 147639 - RNA, 1410 nt, Artificial Sequence; identical to SEQ ID NO: 147614
  derived and/or modified sequence opt3 from neuraminidase__InfluenzaA__AIJ10857

SEQ ID NO: 147640 - RNA, 1410 nt, Artificial Sequence; identical to SEQ ID NO: 144162
  derived and/or modified sequence opt3 from neuraminidase__InfluenzaA__AIJ29348

SEQ ID NO: 147641 - RNA, 1410 nt, Artificial Sequence; identical to SEQ ID NO: 144162
  derived and/or modified sequence opt3 from neuraminidase__InfluenzaA__AIJ29350

SEQ ID NO: 147642 - RNA, 1410 nt, Artificial Sequence
  derived and/or modified sequence opt3 from neuraminidase__InfluenzaA__AIJ29352
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcuaaguacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggaaauucugcggacgcaggagagcgaaugugugugcauaaacggcacuuguacagucgugaugaccgaugggucugcuuccggaaaagcagacacuaagauccuguuuauugaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucgugucgucuuacgucuguuccggcuuagugggugacacgccucgcaaaaaugacucaaguagcuccucucauugccuggauccaaacaaugaagaagggggacacggcguuaagggcugggcuuucgacgaugggaacgacguguggaugggacgaaccauuaaugagacaagcagacuugguuaugagacuuuuaaagucaucgagggcuggucaaaccccaagaguaaauugcagauuaauaggcaagugauaguagaucguggggaccgguccggauacagcggcaucuucucuguugaagguaagucauguauuaaccgcugcuuuuauguggagcugaucagagggaggaaggaagagaccgaaguccuauggacaaguaauagcaucguggucuucuguggcacuuccggaaccuacggcacagggucuuggccugauggagccgaccucaaccugaugccaauuuga

SEQ ID NO: 147643 - RNA, 1410 nt, Artificial Sequence; identical to SEQ ID NO: 143159
  derived and/or modified sequence opt3 from neuraminidase__InfluenzaA__AIJ29354

SEQ ID NO: 147644 - RNA, 1410 nt, Artificial Sequence; identical to SEQ ID NO: 144938
  derived and/or modified sequence opt3 from neuraminidase__InfluenzaA__AIJ29356

SEQ ID NO: 147645 - RNA, 1410 nt, Artificial Sequence; identical to SEQ ID NO: 144938
  derived and/or modified sequence opt3 from neuraminidase__InfluenzaA__AIJ29358

SEQ ID NO: 147646 - RNA, 1410 nt, Artificial Sequence
  derived and/or modified sequence opt3 from neuraminidase__InfluenzaA__AIJ29360
augaaccccaaucagaagaucauuaccauaggcagcgugucccugacaaucucuacuauuugcuucuuuaugcagaucgccauucucacgaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugggaucaccggauucgcacccuuuagcaaagacaacuccauacgguuaucugccgguggcgauauuuggguaacgcgcgagccuuaugugucgugcgacccagauaaguguuaccaauucgcgcuggggcagggaacuacccuaaauaacguccauucaaauaacacagugcgagaccguacucccuauagaacccuccugaugaaugaacuuggcguuccuuuucaccuggguacaaaacaggugugcaucgcuuggagcaguuccucuugucaugaugggaaggccugguugcacgucugcauuaccggagacgauaagaacgcaacggccagcuucaucuacaauggcaggcucguggacuccguaguuucauggaguaaagagauccugcggacucaggaaagcgagugugugugcauuaacggcacauguaccgucgugaugacugaugggucugcuuccggaaaggcagacacaaaaauacuguuuaucgaggaagguaagauugugcauaccucaacgcucagcggcagugcccaacacgucgaggaaugcucuugcuauccacgcuacccggggguuagaugugugugcagggauaacuggaagggauccaaucggcccaucguagacauaaacauuaaagaucacagcaucgugucgucuuacgucuguuccggcuuagugggugacaccccucgcaagaaugacucaaguagcuccucucauugccuggauccaaacaaugaggaagggggacacggcguuaaaggcugggcuuucgacgaugggaacgacguguggaugggacgaacaaucaaugagacuagcagacuugguuaugagaccuuuaaggucauugaaggcuggucaaaccccaaaaguaaguugcagaucaauaggcaagugauuguagaucguggggaccgguccggauacagcggcauauucucuguugaggguaaaucauguaucaaccgcugcuuuuauguggaacugauuagagggaggaaggaggaaacagagguccuauggaccaguaauagcaucguggucuucuguggcacuuccggaacauacggcaccgggucuuggccugauggagccgaccucaaccugaugccaaucuga

SEQ ID NO: 147647 - RNA, 1410 nt, Artificial Sequence; identical to SEQ ID NO: 144162
  derived and/or modified sequence opt3 from neuraminidase__InfluenzaA__AIJ29362

SEQ ID NO: 147648 - RNA, 1410 nt, Artificial Sequence
  derived and/or modified sequence opt3 from neuraminidase__InfluenzaA__AIL93626
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguauguuaaccagaccuacgugaauaucuccaacacaaauuucgcagccggcagaucuguagugucggucaaacuggcggggaacagcucauugugcccugugaguggaugggcuauauauuccaaggacaauucuguuaggauuggcagcaaaggugauguguuugucauccgggagccauucauuuccuguucaccguuagaaugccgcaccuuuuuccugacucagggggcccuacucaacgacaagcauaguaauggaacaaucaaagaucgaagccccuaccguacccugaugucuuguccuaucggcgaggugccaucccccuauaacucaagauuugaaagcguagcauggagugccucugcuugccacgacggcauuaacuggcuuacuauagggaucuccggaccugauagcggugcaguugccgugcugaaguacaauggcauuaucacagacaccauaaagucguggaaaaacaauauuuugaggacgcaggagucugagugugcuugcgucaacggguccuguuucacuaucaugaccgauggaccaucagacggccaagccaguuauaagaucuuucggauugaaaaagguaagaucgugaaaagcguggagaugaaugcgcccaacuaccauuacgaagagugcuccuguuauccugauucuagcgagauuacaugcgucugccgcgacaauuggcacgggucaaacagaccauggguuaguuucaaucagaaccucgaauaccagauaggauauaucuguuccggcguguuuggcgauaauccgaggcccaacgacaagacugggagcugcggaccuguacugucuaauggugcaaacggcgugaagggguucucauuuaaauacggaaauggcgucuggauuggucggaccaagaguaucagcucccgcaaaggguucgagaugaucugggauccaaacggcuggacaggaaccgacaacaauuuuucuauuaagcaggacauagugggcaucaacgaauggucgggguauagcggauccuucguucaacaucccgagcugacgggucucgauuguauucgaccuugcuucuggguggaauuaaucagaggcaggccaaaagagaauacuauuuggacaucagggaguucuaucagcuuuuguggagucaacuccgacaccgugggcuggucauggcccgauggugccgagcugccguucacuauagacaaguga

SEQ ID NO: 147649 - RNA, 1410 nt, Artificial Sequence
  derived and/or modified sequence opt3 from neuraminidase__InfluenzaA__AIL93648
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaaggucgcaucgugcauacaucaacccucagcggcagugcccaacacgucgaggaaugcucuugcuauccaagauacccggggguuaggugugugugccgggauaacuggaagggauccaaucgccccauaguagacauuaacaucaaggaucacagcaucgugucgucuuacgucuguuccggcuuagugggugacacgccucggaaaaaugacucaaguagcuccucucauugccuggauccaaacaaugaggaagggggacacggcguuaagggcugggcuuucgacgaugggaacgacguguggaugggaagaaccauuaaugagacaagcaggcuugguuaugagacuuuuaaagucaucgaaggcuggucaaaccccaagaguaaauugcagauuaauaaacaggugauaguagaucgaggggaccguuccggauacagcggcaucuucucuguugaggguaagucauguauuaaccgcugcuuuuauguggaacugaucagagggaggaaggaggaaaccgagguccuauggacaaguaauagcaucguggucuucuguggcacuuccggaaccuacggcacagggucuuggccugauggagccgaccucaaccugaugccaauuuga

SEQ ID NO: 147650 - RNA, 1410 nt, Artificial Sequence; identical to SEQ ID NO: 144162
  derived and/or modified sequence opt3 from neuraminidase__InfluenzaA__AIL93660

SEQ ID NO: 147651 - RNA, 1410 nt, Artificial Sequence; identical to SEQ ID NO: 144162
  derived and/or modified sequence opt3 from neuraminidase__InfluenzaA__AIL93672

SEQ ID NO: 147652 - RNA, 1410 nt, Artificial Sequence
  derived and/or modified sequence opt3 from neuraminidase__InfluenzaA__AIL93684
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauucugcaacuggccagucgguagugucagucaaacuggccgggaacagcaguuugugcccuguguccggaugggcgauauacucuaaggacaauagcguuagaauuggcuccaaaggugauguguucgucaucagggagccauuuauuucauguaguccguuagaaugccggaccuucuuucugacacagggggcucuacucaacgacaagcauagcaauggaaccaucaaagaucgcucucccuaucgaacucugauguccuguccuaucggcgaggugccaucacccuacaacagccguuucgaaaguguagccuggucugcauccgccugccacgacggcauuaacuggcuuacaauagggaucagcggaccugauucgggugcuguugcagugcugaaguauaauggcauuaucaccgacacgauaaagucuuggaaaaacaauauuuugagaacucaagaguccgagugugccugcgucaacgggucauguuuuaccaucaugacagauggaccaagugacggccaggcuagcuacaagaucuucaggauugaaaaagguaagaucgugaaauccguggagaugaaugcccccaacuaucauuacgaagagugcucuuguuacccugauagcucagagauuacuugcgucugccgggacaauuggcacgggaguaaccgcccauggguuuccuuuaaucagaaccucgaauaucagauaggauacaucuguagcggcguguucggcgauaauccgagacccaacgacaagaccgggucuugcggaccuguacugucaaauggugcgaacggcgugaagggguuuaguuucaaauauggaaauggcgucuggauugguaggacaaagagcaucuccucucggaaaggguuugagaugaucugggauccaaacggcuggaccggaacggacaacaauuucucgauuaagcaagacauagugggcaucaacgaauggagcggguacuccggaucauuuguucagcaucccgagcugacuggucucgauuguauucgcccuugcuucuggaucgaauuaauucgaggcagaccaaaagagaauacaaucuggaccagugggucuagcauauccuucuguggagugaacucagacacugucggcuggagcuggcccgauggugcagagcugccguuuacaaucgacaaguga

SEQ ID NO: 147653 - RNA, 1410 nt, Artificial Sequence
  derived and/or modified sequence opt3 from neuraminidase__InfluenzaA__AIL93719
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaaacaggugauaguagauaggggagaccgguccggguacagcggcaucuucucuguugaggguaagucauguauuaaccguugcuuuuauguggaacugauccgcgggagaaaggaggaaaccgagguccuauggacaaguaauagcaucguggucuucuguggcacuuccggaaccuacggcacagggucuuggccugauggagccgaccucaaccugaugccaauuuga

SEQ ID NO: 147654 - RNA, 1410 nt, Artificial Sequence; identical to SEQ ID NO: 147653
  derived and/or modified sequence opt3 from neuraminidase__InfluenzaA__AIL93743

SEQ ID NO: 147655 - RNA, 1410 nt, Artificial Sequence; identical to SEQ ID NO: 147653
  derived and/or modified sequence opt3 from neuraminidase__InfluenzaA__AIL93755

SEQ ID NO: 147656 - RNA, 1410 nt, Artificial Sequence; identical to SEQ ID NO: 144162
  derived and/or modified sequence opt3 from neuraminidase__InfluenzaA__AIL93767

SEQ ID NO: 147657 - RNA, 1410 nt, Artificial Sequence; identical to SEQ ID NO: 144162
  derived and/or modified sequence opt3 from neuraminidase__InfluenzaA__AIL93779

SEQ ID NO: 147658 - RNA, 1410 nt, Artificial Sequence
  derived and/or modified sequence opt3 from neuraminidase__InfluenzaA__AIL93791
augaaccccaaucagaagaucauuaccauaggcagcgugucccugacaaucucuacuauuugcuucuuuaugcaaaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaagccugcugaauacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggaaauucugcggacgcaggagagcgaaugugugugcauaaacggcacuuguacagucgugaugaccgaugggucugcuuccggaaaagcagacacuaagauccuguuuauugaggaggguaagaucgugcauacacgcacccucucaggcagcgcccaacacgucgaagagugcaguugcuauccaagauacccggggguuaggugugugugccgggauaacuggaaaggaucuaaucgccccauaguagacauuaacaucaaggaucacuccaucgugagcucguacgucuguucuggcuuagugggugacacgccucggaaaaaugacuccucaaguagcucccauugccuggauccaaacaaugaagaagggggacacggcguuaagggcugggcuuucgacgaugggaacgacguguggaugggaagaaccauuaaugagacaucuaggcuugguuaugagacuuuuaaagucaucgagggcuggagcaaccccaagucaaaauugcagauuaauaaacaggugauaguagaucgaggggaccguaguggauacuccggcaucuucagcguugaagguaagucuuguauuaaccgcugcuuuuauguggagcugaucagagggaggaaggaagagaccgaaguccuauggacaucaaauaguaucguggucuucuguggcacuagcggaaccuacggcacaggguccuggccugauggagccgaccucaaccugaugccaauuuga

SEQ ID NO: 147659 - RNA, 1410 nt, Artificial Sequence; identical to SEQ ID NO: 147653
  derived and/or modified sequence opt3 from neuraminidase__InfluenzaA__AIL93803

SEQ ID NO: 147660 - RNA, 1410 nt, Artificial Sequence
  derived and/or modified sequence opt3 from neuraminidase__InfluenzaA__AIL93815
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucguguacucguaugucuguucuggcuuagugggugacacgccucgcaagaaugacuccucaaguagcucccauugccugaacccaaauaacgaggaagggggacacggcguuaaaggcugggcuuucgaugacgggaaugauguguggaugggacgaaccauuaacgagacaucuagacuugguuacgagacuuuuaaggucaucgaaggcuggagcaaucccaaaucaaaguugcagauuaacaggcaagugauaguagaccguggggaucggaguggauauuccggcaucuucagcguugaggguaaaucuuguauuaaucgcugcuuuuacguggaacugaucagagggaggaaggaggaaaccgagguccuauggacaucaaacaguaucguggucuucuguggcacuagcggaaccuauggcacaggguccuggccugacggagccgaucucaaucugaugccaauuuga

SEQ ID NO: 147661 - RNA, 1410 nt, Artificial Sequence; identical to SEQ ID NO: 144162
  derived and/or modified sequence opt3 from neuraminidase__InfluenzaA__AIL93827

SEQ ID NO: 147662 - RNA, 1410 nt, Artificial Sequence
  derived and/or modified sequence opt3 from neuraminidase__InfluenzaA__AIL93839
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcaacuggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggaaaaacaauauuuugagaacucaagagucugagugugccugcgucaacggguccuguuucaccaucaugacagauggaccaucagacggccaggcuaguuacaagaucuuuaggauugaaaaagguaagaucgugaaaagcguggagaugaaugcccccaacuaucauuacgaagagugcuccuguuacccugauucuagcgagauuacuugcgucugccgggacaauuggcacgggucaaaccgcccauggguuaguuucaaucagaaccucgaauaucagauaggauacaucuguuccggcguguuuggcgauaauccgagacccaacgacaagaccgggagcugcggaccuguaucuucaaauggugcgaacggcgugaagggguucaguuuuaaauauggaaauggcgucuggauugguaggacaaagagcaucuccucucggaaaggguucgagaugaucugggauccaaacggcuggaccggaacggacaacaauuuuucgauuaagcaagacauagugggcaucaacgaauggagcggguacuccggaucauucguucagcaucccgagcugacuggucuggauuguauucgcccuugcuucuggguggaacucauccgaggcagaccaaaagagaauacaauuuggaccagugggucuagcaucuccuuuuguggagucaacucagacacugugggcuggagcuggcccgauggugcagaguuaccguucacaauagacaaguga

SEQ ID NO: 147663 - RNA, 1410 nt, Artificial Sequence
  derived and/or modified sequence opt3 from neuraminidase__InfluenzaA__AIL93850
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcaacuggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggaaaaacaauauuuugagaacucaagagucugagugugccugcgucaacggguccuguuucaccaucaugacagauggaccaucagacggccaggcuaguuacaagaucuuuaggauugaaaaagguaagaucgugaaaagcguggagaugaaugcccccaacuaucauuacgaagagugcuccuguuacccugauucuagcgagauuacuugcgucugccgggacaauuggcacgggucaaaccgcccauggguuaguuucaaucagaaccucgaauaucagauaggauacaucuguuccggcguguuuggcgauaauccgagacccaacgacaagaccgggagcugcggaccuguaucuucaaauggugcgaagggcgugaaaggguucaguuuuaaguauggaaacggcgucuggauugguaggacaaaaagcaucuccucucggaagggguucgagaugaucugggauccaaauggcuggaccggaacggacaacaacuuuucgauuaaacaagacauagugggcaucaaugaauggagcggguacuccggaucauucguucagcaucccgagcugacuggucuggauuguauucgcccuugcuucuggguggaacucauccgaggcagaccaaaggagaacacaauuuggaccagugggucuagcaucuccuuuuguggagucaauucagacacugugggcuggagcuggcccgauggugcagaguuaccguucacaauagacaaauga

SEQ ID NO: 147664 - RNA, 1410 nt, Artificial Sequence; identical to SEQ ID NO: 147653
  derived and/or modified sequence opt3 from neuraminidase__InfluenzaA__AIL93861

SEQ ID NO: 147665 - RNA, 1410 nt, Artificial Sequence
  derived and/or modified sequence opt3 from neuraminidase__InfluenzaA__AIL93885
augaaccccaaucagaagaucauuaccauaggcagcgugucccugacaaucucuacuauuugcuucuuuaugcagaucgccauucucaucacgaccgucacacuucacuucaaacaguacgaguuugacucaccuccaaacaaucagguuaugcugugugaaccgacuauaaucgagagaaacauuaccgaaaucguguauuugacaaauaccacuauugagaaggaaaucugccccaaaccugcugaguacaggaacuggaguaagccacagugugggauaacaggauucgcacccuuuagcaaagauaauuccauucgguuaucugccgguggcgacaucuggguaacccgcgagccuuaugugucgugcgauccagacaaguguuaccaauucgcgcuggggcagggaacgacucuaaacaauguccauucaaacaauaccgugcgagaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaauggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaacuggaagggauccaaccggcccauaguagauauuaauaucaaagaccacagcaucgugucgucuuacgucuguuccggcuuagugggugacacgccucgcaagaacgauucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcguuuucucuguggaggguaaaucauguaucaaucgcugcuuuuaugucgaacugauuagagggaggaaggaggaaaccgaggugcuauggacaaguaacagcaucgucguguucuguggcacuuccggaaccuacggcacagggucuuggccugacggagccgaucucaaucugaugccaaucuga

SEQ ID NO: 147666 - RNA, 1410 nt, Artificial Sequence; identical to SEQ ID NO: 147653
  derived and/or modified sequence opt3 from neuraminidase__InfluenzaA__AIL93897

SEQ ID NO: 147667 - RNA, 1410 nt, Artificial Sequence
  derived and/or modified sequence opt3 from neuraminidase__InfluenzaA__AIL93909
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauagcggugcuguagcaguucugaaguauaauggcaucauaaccgacacgauuaagucguggagaaacaauaucuugaggacucaagagucugagugugugugcgucaacggguccuguuucaccaucaugacagauggaccaucagacggccaggccaguuacaaaauuuuucggaucgaaaaggguaaaauugugaagucaguggagaugaaugcucccaacuaucauuacgaagagugcuccuguuacccugauucuagcgagauaacuugcgucugccgcgacaauuggcacgggucaaacagaccauggguuaguuucaaucagaaccucgaauaucagaucggauacauuuguuccggcaucuuuggcgauaauccgaggcccaacgacaaaaccgggagcugcggaccugugucuucaaauggugccaacggcguaaagggguucaguuuuaaguauggaaauggcguguggaucggucggacaaaaagcauuuccucucgcaagggguucgagaugauaugggauccaaacggcuggaccggaacggacaacaauuuuucgaucaaacaagacauugucggcaucaacgaauggagcggguacuccggaucauucgugcagcaucccgagcugacuggucuggauuguauucgaccuugcuucuggguugaacucaucagaggcaggccaaaggagaauacaauauggaccagugggucuagcaucuccuuuuguggagugaacucagacacugucggcuggagcuggcccgauggugcggaguuaccguucacaauugacaaauga

SEQ ID NO: 147668 - RNA, 1410 nt, Artificial Sequence; identical to SEQ ID NO: 147653
  derived and/or modified sequence opt3 from neuraminidase__InfluenzaA__AIL93920

SEQ ID NO: 147669 - RNA, 1410 nt, Artificial Sequence
  derived and/or modified sequence opt3 from neuraminidase__InfluenzaA__AIL93943
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcucauugugcccuguuaguggaugggcgaucuacuccaaggacaauucugugagaauaggcagcaaaggugaugucuuugugauuagggagccauucaucuccuguucaccgagugaaugccggaccuuuuucuuaacacagggggcucugcuaaacgacaagcauagcaauggaaccauuaaagaucgcucucccuaucgaacucucauguccuguccuaucggcgagguaccaucacccuacaacagccguuuugaaaguguugccuggucugcauccgccugccacgacggcaucaacuggcugacaauugggauaagcggaccugauucgggugcuguggcaguccuuaaguauaauggcaucauuaccgacacgaucaagucuuggagaaacaauauacugaggacucaagaguccgagugugccugcgugaacgggucauguuucaccauuaugacagauggaccaagugacggccaggcuagcuacaaaaucuuucggaucgaaaaggguaaaauugugaaguccgucgagaugaaugcccccaacuaucauuacgaagagugcucuuguuacccugauagcucagagaucacuugcguuugccgcgacaauuggcacgggaguaacagaccauggguguccuucaaucagaacuuggaauaucagauuggauacauauguagcggcguauuuggcgauaauccgaggcccaacgacaaaaccgggucuugcggaccugugucaaguaauggugcgaacggcgucaagggguucagcuuuaaguauggaaauggcguguggaucggucggacaaaauccauuucuucgcgcaagggguucgagaugaucugggauccaaacggcuggaccggaacggacaacaauuuuagcaucaaacaagacauuguuggcauaaaggaaugguccggguacucaggaaguuucgugcagcaucccgagcucacuggucuggauuguauccgaccuugcuucugggucgaacugauuagaggcaggccagaggagaacacaaucuggaccucugggagcuccauuucauuuuguggagugaauagcgacacuguaggcuggucuuggcccgauggugcagaacucccguucacaaucgacaaauga

SEQ ID NO: 147670 - RNA, 1410 nt, Artificial Sequence; identical to SEQ ID NO: 147653
  derived and/or modified sequence opt3 from neuraminidase__InfluenzaA__AIL93954

SEQ ID NO: 147671 - RNA, 1410 nt, Artificial Sequence; identical to SEQ ID NO: 147653
  derived and/or modified sequence opt3 from neuraminidase__InfluenzaA__AIL93966

SEQ ID NO: 147672 - RNA, 1410 nt, Artificial Sequence
  derived and/or modified sequence opt3 from neuraminidase__InfluenzaA__AIL93978
augaaccccaaucagaagaucauuaccauaggcagcgugucccugacaaucucuacuauuugccucuucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaaccugcugaguacaggaauuggaguaagccacagugugggauaacaggauuugcacccuucagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugaaugaacugggcguuccuuuccacuuggguaccaaacaggugugcauugcuuggagcaguuccucuugucaugaugggaaggccuggcuccacgucugcaucacaggagacgauaagaacgcaaccgccagcuuuaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcauacaucaaccuuaagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggccuggugggugacacgccucgcaagaaugacucaaguagcuccucucauugccuugauccaaacaaugaggaagggggacacggcguuaaaggcugggcuuuugacgaugggaacgacguguggaugggacgaaccauuaaugagacaagcagauuggguuaugagacuuucaaggucaucgaaggcuggucaaaccccaaaaguaagcugcagauuaauaggcaagugauaguagaucguggggaccgguccggauacagcggcaucuuuucuguugaggguaaaucauguauuaaccgcugcuucuauguggaacuaaucagagggaggaaggaggaaaccgagguccucuggacaaguaauagcaucguggucuuuuguggcacuuccggaaccuacggcacagggucuuggccugauggagccgaccugaaccuuaugccaauuuga

SEQ ID NO: 147673 - RNA, 1410 nt, Artificial Sequence; identical to SEQ ID NO: 147662
  derived and/or modified sequence opt3 from neuraminidase__InfluenzaA__AIL93990

SEQ ID NO: 147674 - RNA, 1410 nt, Artificial Sequence; identical to SEQ ID NO: 144162
  derived and/or modified sequence opt3 from neuraminidase__InfluenzaA__AIL94001

SEQ ID NO: 147675 - RNA, 1410 nt, Artificial Sequence; identical to SEQ ID NO: 147653
  derived and/or modified sequence opt3 from neuraminidase__InfluenzaA__AIL94013

SEQ ID NO: 147676 - RNA, 1410 nt, Artificial Sequence; identical to SEQ ID NO: 147653
  derived and/or modified sequence opt3 from neuraminidase__InfluenzaA__AIL94025

SEQ ID NO: 147677 - RNA, 1410 nt, Artificial Sequence; identical to SEQ ID NO: 147653
  derived and/or modified sequence opt3 from neuraminidase__InfluenzaA__AIL94037

SEQ ID NO: 147678 - RNA, 1410 nt, Artificial Sequence; identical to SEQ ID NO: 147653
  derived and/or modified sequence opt3 from neuraminidase__InfluenzaA__AIL94049

SEQ ID NO: 147679 - RNA, 1410 nt, Artificial Sequence; identical to SEQ ID NO: 147662
  derived and/or modified sequence opt3 from neuraminidase__InfluenzaA__AIL94061

SEQ ID NO: 147680 - RNA, 1410 nt, Artificial Sequence
  derived and/or modified sequence opt3 from neuraminidase__InfluenzaA__AIL94072
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcaacuggccagucuguagugucggucaaacuggccgggaacagcagcuugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggaaaaacaauauuuugagaacucaagagucugagugugccugcgucaacggguccuguuucaccaucaugacagauggaccaucagacggccaggcuaguuacaagaucuuuaggauugaaaaagguaagaucgugaaaagcguggagaugaaugcccccaacuaucauuacgaagagugcuccuguuacccugauucuagcgagauuacuugcgucugccgggacaauuggcacgggucaaaccgcccauggguuaguuucaaucagaaccucgaauaucagauaggauacaucuguuccggcguguuuggcgauaauccgagacccaacgacaagaccgggagcugcggaccuguacugucuaauggugcgaacggcgugaagggguucucauuuaaauauggaaauggcgucuggauugguaggacaaagaguaucagcucccggaaaggguucgagaugaucugggauccaaacggcuggaccggaacggacaacaauuuuucuauuaagcaagacauagugggcaucaacgaauggucgggguacagcggauccuucguucagcaucccgagcugacuggucucgauuguauucgcccuugcuucuggaucgaauuaauucgaggcagaccaaaagagaauacaaucuggaccucagggaguucuauaucauuuuguggagugaacuccgacacugucggcuggucauggcccgauggugcagagcugccguucacaaucgacaaguga

SEQ ID NO: 147681 - RNA, 1410 nt, Artificial Sequence; identical to SEQ ID NO: 147662
  derived and/or modified sequence opt3 from neuraminidase__InfluenzaA__AIL94083

SEQ ID NO: 147682 - RNA, 1410 nt, Artificial Sequence; identical to SEQ ID NO: 147653
  derived and/or modified sequence opt3 from neuraminidase__InfluenzaA__AIL94238

SEQ ID NO: 147683 - RNA, 1410 nt, Artificial Sequence
  derived and/or modified sequence opt3 from neuraminidase__InfluenzaA__AIL94250
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugucggucaaacuggcggggaacagcucauugugcccugugaguggaugggcuauauacuccaaggacaauucuguuagaauuggcagcaaaggugauguguuugucaucagggagccauucauuuccuguucaccguuagaaugccggaccuuuuuccugacucagggggcccuacucaacgacaagcauaguaauggaacaaucaaagaucgcagccccuaucgaacccugaugucuuguccuaucggcgaggugccaucccccuacaacucacguuuugaaagcguagcauggagugccucugcuugccacgacggcauuaacuggcuuacuauagggaucuccggaccugauagcggugcaguugccgugcugaaguauaauggcauuaucacagacaccauaaagucguggaaaaacaauauuuugagaacgcaagagucugagugugcuugcgucaacggguccuguuucacuaucaugaccgauggaccaaaugacggccaggccucauacaagaucuuuaggauugaaaaagguaagaucgugaaaaguguggagaugaacgcgcccaauuaucauuacgaagagugcagcuguuacccugauuccucugagauuacaugcgucugccgggacaacuggcacgggagcaaucgcccauggguuucauucaaccagaaucucgaauaucagauaggauacaucuguaguggcguguuuggcgauaacccgagacccaaugacaagacuggguccugcggaccuguaagcucuaacggugcaaauggcgugaagggguucucauuuaaauauggaaacggcgucuggauugguaggaccaagaguaucagcucccggaaaggguucgagaugaucugggauccaaacggcuggacaggaaccgacaauaacuuuucuauuaagcaagacauagugggcaucaaugaauggucgggguacagcggauccuucguucagcaucccgagcugacgggucuggauuguauucgcccuugcuucuggguggaacucauccgaggcagaccaaaagagaacacuauuuggacaucagggaguucuaucagcuuuuguggagucaauuccgacaccgugggcuggucauggcccgauggugccgaguuaccguucacuauagacaaguga

SEQ ID NO: 147684 - RNA, 1410 nt, Artificial Sequence; identical to SEQ ID NO: 144162
  derived and/or modified sequence opt3 from neuraminidase__InfluenzaA__AIL94261

SEQ ID NO: 147685 - RNA, 1410 nt, Artificial Sequence; identical to SEQ ID NO: 144162
  derived and/or modified sequence opt3 from neuraminidase__InfluenzaA__AIL94273

SEQ ID NO: 147686 - RNA, 1410 nt, Artificial Sequence; identical to SEQ ID NO: 144162
  derived and/or modified sequence opt3 from neuraminidase__InfluenzaA__AIL94285

SEQ ID NO: 147687 - RNA, 1410 nt, Artificial Sequence
  derived and/or modified sequence opt3 from neuraminidase__InfluenzaA__AIL94297
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacacgcacccucucaggcagcgcccaacacgucgaggaaugcaguugcuauccaagauacccggggguuaggugugugugccgggauaacuggaagggaucuaaucgccccauaguagacauuaacaucaaagaucacuccaucgugagcucguacgucuguucuggcuuagugggugacacgccucgaaagaaugacuccucaaguagcucccauugccuggauccaaacaaugaggaagggggacacggcguuaaaggcugggcuuucgacgaugggaacgacguguggaugggaagaaccauuaaugagacaucuaggcuugguuaugagacuuuuaaggucaucgaaggcuggagcaaccccaaaucaaaguugcagauuaauaaacaggugauaguagaucguggggaccggaguggauacuccggcaucuucagcguugaggguaagucuuguauuaaccgcugcuuuuauguggaacugaucagagggaggaaggaggaaaccgagguccuauggacaucaaauaguaucguggucuucuguggcacuagcggaaccuacggcacaggguccuggccugauggagccgaccucaaccugaugccaauuuga

SEQ ID NO: 147688 - RNA, 1410 nt, Artificial Sequence; identical to SEQ ID NO: 147653
  derived and/or modified sequence opt3 from neuraminidase__InfluenzaA__AIL94309

SEQ ID NO: 147689 - RNA, 1410 nt, Artificial Sequence; identical to SEQ ID NO: 147672
  derived and/or modified sequence opt3 from neuraminidase__InfluenzaA__AIL94321

SEQ ID NO: 147690 - RNA, 1410 nt, Artificial Sequence; identical to SEQ ID NO: 144162
  derived and/or modified sequence opt3 from neuraminidase__InfluenzaA__AIL94368

SEQ ID NO: 147691 - RNA, 1410 nt, Artificial Sequence
  derived and/or modified sequence opt3 from neuraminidase__InfluenzaA__AIL94380
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccguaguggacauaaacauuaaagaucacagcaucgucucgucuuacguguguuccggcuuaguuggugacacgccucgcaagaaugacucaaguagcuccucucauugccuggauccaaacaaugaggaagggggacacggcgugaaaggcugggcuuucgacgaugggaacgacgucuggaugggacgaaccaucaaugagacaagcagacuugguuaugagacuuuuaaggugauugaaggcuggucaaaccccaaaaguaaguugcagaucaauaaacagguaauuguugauaggggagaccgguccggguacagcggcauauucucuguggaggguaagucauguaucaaccguugcuuuuaugucgaacugauucgcgggagaaaggaggaaaccgaggugcuauggacaaguaauagcaucgucguguucuguggcacuuccggaaccuacggcacagggucuuggccugauggagccgaccucaaccugaugccaaucuga

SEQ ID NO: 147692 - RNA, 1410 nt, Artificial Sequence
  derived and/or modified sequence opt3 from neuraminidase__InfluenzaA__AIL94392
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugucggucaaacuggcggggaacagcucauugugcccugugaguggaugggcuauauacuccaaggacaauucuguuagaauuggcagcaaaggugauguguuugucaucagggagccauucauuuccuguucaccguuagaaugccggaccuuuuuccugacucagggggcccuacucaacgacaagcauaguaauggaacaaucaaagaucgcagccccuaucgaacccugaugucuuguccuaucggcgaggugccaucccccuacaacucacguuuugaaagcguagcauggagugccucugcuugccacgacggcauuaacuggcuuacuauagggaucuccggaccugauagcggugcaguugccgugcugaaguauaauggcauuaucacagacaccauaaagucguggaaaaacaauauuuugagaacgcaagagucugagugugcuugcgucaacggguccuguuucacuaucaugaccgauggaccaucagacggccaggccaguuacaagaucuuuaggauugaaaaagguaagaucgugaaaagcguggagaugaaugcgcccaacuaucauuacgaagagugcuccuguuacccugauucuagcgagauuacaugcgucugccgggacaauuggcacgggucaaaccgcccauggguuaguuucaaucagaaccucgaauaucagauaggauacaucuguuccggcguguuuggcgauaauccgagacccaacgacaagacugggagcugcggaccuguaucuucaaauggugcaaacggcgugaagggguucaguuuuaaauauggaaauggcgucuggauugguaggaccaagagcaucuccucucggaaaggguucgagaugaucugggauccaaacggcuggacaggaaccgacaacaauuuuucgauuaagcaagacauagugggcaucaacgaauggagcggguacuccggaucauucguucagcaucccgagcugacgggucuggauuguauucgcccuugcuucuggguggaacucauccgaggcagaccaaaagagaauacuauuuggacaagugggucuagcaucuccuuuuguggagucaacucagacaccgugggcuggagcuggcccgauggugccgaguuaccguucacuauagacaaguga

SEQ ID NO: 147693 - RNA, 1410 nt, Artificial Sequence
  derived and/or modified sequence opt3 from neuraminidase__InfluenzaA__AIL94403
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugucggucaaacuggcggggaacagcucauugugcccugugaguggaugggcuauauacuccaaggacaauucuguuagaauuggcagcaaaggugauguguuugucaucagggagccauucauuuccuguucaccguuagaaugccggaccuuuuuccugacucagggggcccuacucaacgacaagcauaguaauggaacaaucaaagaucgcagccccuaucgaacccugaugucuuguccuaucggcgaggugccaucccccuacaacucacguuuugaaagcguagcauggagugccucugcuugccacgacggcauuaacuggcuuacuauagggaucuccggaccugauagcggugcaguugccgugcugaaguauaauggcauuaucacagacaccauaaagucguggaaaaacaauauuuugagaacgcaagagucugagugugcuugcgucaacggguccuguuucacuaucaugaccgauggaccaucagacggccaggccaguuacaagaucuuuaggauugaaaaagguaagaucgugaaaagcguggagaugaaugcgcccaacuaucauuacgaagagugcuccuguuacccugauucuagcgagauuacaugcgucugccgggacaauuggcacgggucaaaccgcccauggguuaguuucaaucagaaccucgaauaucagauaggauacaucuguuccggcguguuuggcgauaauccgagacccaacgacaagacugggagcugcgauccuguaucuucaaauggagcaaacggugugaagggcuucaguuuuaaauaugggaauggagucuggauuggcaggaccaagagcaucuccucucggaaagguuucgagaugaucugggacccaaacggguggacaggcaccgacaacaauuuuucgauuaagcaagauauagugggaaucaacgaauggagcggcuacuccgggucauucguucagcaucccgagcugacgggacuggacuguauucgcccuugcuucuggguggaacucauccgagguagaccaaaagagaauacuauuuggacaaguggcucuagcaucuccuuuuguggggucaacucagauaccgugggauggagcuggcccgacggcgccgaguuaccguucacuauagauaaguga

SEQ ID NO: 147694 - RNA, 1410 nt, Artificial Sequence; identical to SEQ ID NO: 144162
  derived and/or modified sequence opt3 from neuraminidase__InfluenzaA__AIL94426

SEQ ID NO: 147695 - RNA, 1410 nt, Artificial Sequence
  derived and/or modified sequence opt3 from neuraminidase__InfluenzaA__AIL94438
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcaacuggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggaaaaacaauauuuugagaacucaagagucugagugugccugcgucaacggguccuguuucaccaucaugacagauggaccaucagacggccaggcuaguuacaagaucuuuaggauugaaaaagguaagaucgugaaaagcguggagaugaaugcccccaacuaucauuacgaagagugcuccuguuacccugauucuagcgagauuacuugcgucugccgggacaauuggcacgggucaaaccgcccauggguuaguuucaaucagaaccucgaauaucagauaggauacaucuguuccggcguguuuggcgauaauccgagacccaacgacaagaccgggagcugcggaccuguaucuucaaauggugcgaacggcgugaagggguucaguuuuaaauauggaaauggcgucuggauugguaggacaaagagcguguccucucggaaaggguucgagaugaucugggauccaaacggcuggaccggaacggacaacaauuuuucgaucaagcaagacauuguuggcauaaacgaauggagcggguacuccggaucauucgugcagcaucccgagcugacuggucuggauuguauccgcccuugcuucugggucgaacucauucgaggcagaccaaaagagaauacaaucuggaccagugggucuagcauuuccuuuuguggagugaacucagacacuguaggcuggagcuggcccgauggugcagaguuaccguucacaaucgacaaguga

SEQ ID NO: 147696 - RNA, 1410 nt, Artificial Sequence
  derived and/or modified sequence opt3 from neuraminidase__InfluenzaA__AIL94449
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcuaaguacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggaaauucugcggacgcaggagagcgaaugugugugcauaaacggcacuuguacagucgugaugaccgaugggucugcuuccggaaaagcagacacuaagauccuguuuauugaggaggguaagaucgugcauacaucaacccucagcggcagugcccaacacgucgaagagugcucuugcuauccacgcuacccggggguuagaugugugugcagggauaacuggaaaggauccaaucggcccauaguagacauuaacaucaaggaucacagcaucguguacucguaugucuguucuggcuuagugggugacacgccucgcaaaaaugacuccucaaguagcucccauugccugaacccaaauaacgaagaagggggacacggcguuaagggcugggcuuucgaugacgggaaugauguguggaugggacgaaccauuaacgagacaucuagacuugguuacgagacuuuuaaagucaucgagggcuggagcaaucccaagucaaaauugcagauuaacaggcaagugauaguagaccguggggaucggaguggauauuccggcaucuucagcguugaagguaagucuuguauuaaucgcugcuuuuacguggagcugaucagagggaggaaggaagagaccgaaguccuauggacaucaaacaguaucguggucuucuguggcacuagcggaaccuauggcacaggguccuggccugacggagccgaucucaaucugaugccaauuuga

SEQ ID NO: 147697 - RNA, 1410 nt, Artificial Sequence; identical to SEQ ID NO: 147691
  derived and/or modified sequence opt3 from neuraminidase__InfluenzaA__AIL94461

SEQ ID NO: 147698 - RNA, 1410 nt, Artificial Sequence
  derived and/or modified sequence opt3 from neuraminidase__InfluenzaA__AIL94473
augaaccccaaucagaagaucauuaccauaggcagcgugugcaugacaaucgggauggccaaccugauucuccaaaucggaaauauuaucuccauaugggucggucacucuauccagcuuggcaaccagucacagauugagacuuguaaucaaaguguuaucacguacgaaaacaauaccugggugaaccagacauauguaaauauuagcaacacuaauuucgcugcagggcaguccguggucccugugaaacuggccggaaacucuucguugugcccaguuucaggcugggcgaucuacagcaaggacaauagugugagaauagguuccaaaggggaugucuuugugauuagggagccguucaucucuuguagccccuuagaaugccggaccuuuuuccugacacagggagcucuacucaacgacaagcauuccaauggcaccauuaaagaucgcucaccuuaucgaacucugaugaguuguccaaucggcgagguacccagcccuuacaacucucguuuugaauccguugccuggucagcaagcgccugccacgacgggaucaacuggcuuacaauuggaauaagugguccagauucuggcgcuguggcaguccugaaguauaaugggaucauuaccgacacgaucaaguccuggagaaacaauauauugaggacucaagagagcgagugugccugcgugaacggaucguguuucaccauuaugacagauggccccucugacggucaggcuuccuacaaaaucuuucggaucgaaaaggggaaaauugugaagucagucgagaugaauacuccuaacuaucauuacgaagagugcaguuguuacccagauagcuccgagauuaccugcguuugccgcgacaauuggcacggaucuaacagaccgugggugagcuucaaucagaaccucgaauaucagaucggcuacauauguucaggcguauuuggggauaaucccaggccuaacgacaaaacaggaaguugcgguccaguguccagcaauggcgccaacggggucaagggauucucuuuuaaguauggcaaugguguguggaucgggcggaccaaaucaauuaguagccgcaagggcuucgagaugaucugggaucccaacggauggacgggcacugacaacaauuuuuccaucaaacaagacauuguugggauaaaggaauggucuggauacucggguagcuucgugcagcauccugagcugacaggccuggauuguauccgaccaugcuucugggucgaacucauuagagggaggcccgaggagaacaccaucuggacuuccggaucaaguauuucuuuuuguggcgugaauagcgacaucguagguugguccuggccggauggggcggaauuaccuuucacaauagacaaauga

SEQ ID NO: 147699 - RNA, 1410 nt, Artificial Sequence; identical to SEQ ID NO: 146752
  derived and/or modified sequence opt3 from neuraminidase__InfluenzaA__AIL94484

SEQ ID NO: 147700 - RNA, 1410 nt, Artificial Sequence; identical to SEQ ID NO: 147662
  derived and/or modified sequence opt3 from neuraminidase__InfluenzaA__AIL94507

SEQ ID NO: 147701 - RNA, 1410 nt, Artificial Sequence
  derived and/or modified sequence opt3 from neuraminidase__InfluenzaA__AIL94518
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgacguguggaugggacgaaccauuaaugagacaagcagacuugguuaugagacuuuuaaggucaucgaaggcuggucaaaccccaaaaguaaguugcagauuaauaaacaggugauaguagauaggggagaccgguccggguacagcggcaucuucucuguugaggguaagucauguauuaaccguugcuuuuauguggaacugauccgcgggagaaaggaggaaaccgagguccuauggacaaguaauagcaucguggucuucuguggcacuuccggaaccuacggcacagggucuuggccugauggagccgaccucucgcugaugccaauuuga

SEQ ID NO: 147702 - RNA, 1410 nt, Artificial Sequence
  derived and/or modified sequence opt3 from neuraminidase__InfluenzaA__AIL94530
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccugaacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 147703 - RNA, 1410 nt, Artificial Sequence; identical to SEQ ID NO: 147692
  derived and/or modified sequence opt3 from neuraminidase__InfluenzaA__AIL94542

SEQ ID NO: 147704 - RNA, 1410 nt, Artificial Sequence; identical to SEQ ID NO: 147662
  derived and/or modified sequence opt3 from neuraminidase__InfluenzaA__AIL94553

SEQ ID NO: 147705 - RNA, 1410 nt, Artificial Sequence; identical to SEQ ID NO: 147653
  derived and/or modified sequence opt3 from neuraminidase__InfluenzaA__AIL94564

SEQ ID NO: 147706 - RNA, 1410 nt, Artificial Sequence; identical to SEQ ID NO: 147662
  derived and/or modified sequence opt3 from neuraminidase__InfluenzaA__AIL94576

SEQ ID NO: 147707 - RNA, 1410 nt, Artificial Sequence
  derived and/or modified sequence opt3 from neuraminidase__InfluenzaA__AIL94587
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugucggucaaacuggcggggaacagcucauugugcccugugaguggaugggcuauauacuccaaggacaauucuguuagaauuggcagcaaaggugauguguuugucaucagggagccauucauuuccuguucaccguuagaaugccggaccuuuuuccugacucagggggcccuacucaacgacaagcauaguaauggaacaaucaaagaucgcagccccuaucgaacccugaugucuuguccuaucggcgaggugccaucccccuacaacucacguuuugaaagcguagcauggagugccucugcuugccacgacggcauuaacuggcuuacuauagggaucuccggaccugauagcggugcaguugccgugcugaaguauaauggcauuaucacagacaccauaaagucguggaaaaacaauauuuugagaacgcaagagucugagugugcuugcgucaacggguccuguuucacuaucaugaccgauggaccaucagacggccaggccaguuacaagaucuuuaggauugaaaaagguaagaucgugaaaagcguggagauggaugcgcccaauuaucauuacgaagagugcuccuguuacccugacucuagcgagauuacaugcgucugccgggauaacuggcacgggucaaaucgcccauggguuaguuucaaccagaaucucgaauaucagauaggauacaucuguuccggcguguuuggcgacaacccgagacccaaugauaagacugggagcugcggaccuguaucuucaaacggugcaaauggcgugaagggguucaguuuuaaauauggaaacggcgucuggauugguaggaccaagagcaucuccucucggaaaggguucgagaugaucugggacccaaauggcuggaacggaacagacaacaauuuuucgauuaagcaagauauagugggcaucaacgaauggagcggguacuccggaucauucguucagcaucccgagcugaccggucuggacuguauucgcccuugcuucuggguggaacucauccgaggcagaccaaaagagaauacgauuuggacugggggaaguucuaucagcuuuuguggcgucaacuccgauacaguggguuggucauggcccgacggggccgaguuaccguucaccauagauaaguga

SEQ ID NO: 147708 - RNA, 1410 nt, Artificial Sequence; identical to SEQ ID NO: 147692
  derived and/or modified sequence opt3 from neuraminidase__InfluenzaA__AIL94598

SEQ ID NO: 147709 - RNA, 1410 nt, Artificial Sequence
  derived and/or modified sequence opt3 from neuraminidase__InfluenzaA__AIL94609
augaaccccaaucagaagaucauuaccauaggcagcgugucccugacaaucucuacuauuugccucuucaugcaaaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaaccugcugaguacaggaauuggaguaagccacagugugggauaacaggauuugcacccuucagcaaagacaacuccauucggcugucugccgguggcgauaucuggguaacccgcgagccuuaugugucgugcgacccagauaaguguuaccaauuugcgcuagggcagggaacgacucucaauaacguccauucaaauaacaccgugcgagaccguacacccuauagaacucugcuuaugagcgaacugggcguuccuuuccacuuggguaccaaacaggugugcauugcuuggaguuccucuagcugucaugaugggaaggccuggcuccacgucugcaucacaggagacgauaagaaugcaaccgccuccuuuaucuacaacggcaggcugguggacucaguaguuaguuggagcaaagagauucugcggacgcaggaaucugagugugugugcauaaauggcacuuguacagucgugaugaccgauggguccgcuucaggaaaggcagacacuaaaauccucuucauugaggaagguaagaucgugcauacaagcaccuuaaguggcucugcccaacacgucgaggaaugcuccugcuauccacuguacccggggguucgcugugugugcagagauaacuggaagggaagcaacaggcccauaguagacauuaauaucaaagaucacucgaucgugucuuccuacgucuguucaggccuugugggugacacgccucggaagaacgacaguagcuccucuagccauugcuuggauccaaauaacgaggaagggggacacggcguuaaaggcugggcuuuugacgaugggaaugacguguggaugggacgcaccauuaacgagacaucacgacuggguuaugagacuuucaaggucaucgaaggcuggaguaaucccaaauccaagcuacagauuaacagacaggugauaguagauaggggagaccggagcggguacucuggcaucuuuucaguugaggguaaaaguuguauuaaucguugcuucuauguggaacucauccgcgggagaaaggaggaaaccgagguccuguggacaagcaacuccaucguggucuuuuguggcacuucuggaaccuacggcacagggucguggccugauggagccgaccuuaaucugaugccaauuuga

SEQ ID NO: 147710 - RNA, 1410 nt, Artificial Sequence
  derived and/or modified sequence opt3 from neuraminidase__InfluenzaA__AIL94621
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugccugucaaacuggcggggaacucgucauugugcccagugagcggaugggcuauauacaguaaggacaauuccguuagaauuggcucuaaaggugauguguuugucaucagggagccguucauuagcuguucccccuuagaaugccggaccuuuuuccugacucagggggcccuacucaacgacaagcauucaaauggaacaaucaaagaucgcaguccuuaucgaacccugaugagcuguccaaucggcgaggugcccucuccuuacaacucccguuuugaaucaguagcauggagcgccagugcuugccacgacggcauuaacuggcuuacuauagggaucucuggaccagauuccggugcaguugccgugcugaaguauaauggcauuaucacagacaccauaaagagcuggaaaaacaauauuuugagaacgcaagagucggagugugcuugcgucaacgggucuuguuucacuaucaugaccgauggacccuccgacggccaggccucauacaagaucuuuaggauugaaaaagguaagaucgugaaaaguguggagaugaaugcgccuaacuaucauuacgaagagugcagcuguuacccagauuccucugagauuacaugcgucugccgggacaauuggcacgggagcaaccgcccguggguuucauucaaucagaaccucgaauaucagauaggauacaucuguaguggcguguuuggcgauaaucccagaccuaacgacaagacuggguccugcggaccaguaagcucuaauggugcaaacggcgugaagggguucucauuuaaauauggaaauggcgucuggauugguaggaccaagaguaucagcucccggaaaggguucgagaugaucugggaucccaacggcuggacaggaaccgacaacgacuuuucuauuaagcaagauauagugggcaucaaugaauggucgggguacagcggauccuucguucagcauccugagcugacgggucuggacuguauucgcccaugcuucuggguggaacucauccgaggcagacccaaagagaacacuauuuggacaucagggaguucuaucagcuuuuguggagucaauuccgauaccgugggcuggucauggccggacggugccgaguuaccuuucacuauagauaaguga

SEQ ID NO: 147711 - RNA, 1410 nt, Artificial Sequence; identical to SEQ ID NO: 147662
  derived and/or modified sequence opt3 from neuraminidase__InfluenzaA__AIL94632

SEQ ID NO: 147712 - RNA, 1410 nt, Artificial Sequence; identical to SEQ ID NO: 144162
  derived and/or modified sequence opt3 from neuraminidase__InfluenzaA__AIL94643

SEQ ID NO: 147713 - RNA, 1410 nt, Artificial Sequence
  derived and/or modified sequence opt3 from neuraminidase__InfluenzaA__AIL94655
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauagcggugcuguagcaguucugaaguauaauggcaucauaaccgacacgauuaagucguggagaaacaauaucuugaggacucaagagucugagugugccugcgugaacggguccuguuucaccaucaugacagauggaccaucagacggccaggcuaguuacaaaauuuuucggaucgaaaaggguaaaauugucaagagcguggagaugaaugcccccaacuaucauuacgaagagugcuccuguuacccugauucuagcgagauaacuugcgugugccgcgacaauuggcacgggucaaacagaccaugggucaguuucaaucagaaccucgaauaucagaucggauacauuuguuccggcaucuuuggcgauaauccgaggcccaacgacaaaaccgggagcugcggaccuguuucuucaaauggugcgaacggcgugaagggguucaguuuuaaguauggaaauggcguauggaucggucggacaaaaagcauuuccucucgcaagggguucgagaugauaugggauccaaacggcuggaccggaacggacaacaauuuuucgaucaaacaagacauugugggcaucaacgaauggagcggguacuccggaucauucguccagcaucccgagcugacuggucuggauuguauucgaccuugcuucuggguggaacucaucagaggcaggccaaaggagaauacaauauggaccagugggucuagcaucuccuuuuguggaguuaacucagacacugugggcuggagcuggcccgauggugcagaguuaccguucacaauugacaaauga

SEQ ID NO: 147714 - RNA, 1410 nt, Artificial Sequence
  derived and/or modified sequence opt3 from neuraminidase__InfluenzaA__AIL94677
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugccugucaaacuggcggggaacucgucauugugcccagugagcggaugggcuauauacaguaaggacaauuccguuagaauuggcucuaaaggugauguguuugucaucagggagccguucauuagcuguucccccuuagaaugccggaccuuuuuccugacucagggggcccuacucaacgacaagcauucaaauggaacaaucaaagaucgcaguccuuaucgaacccugaugagcuguccaaucggcgaggugcccucuccuuacaacucccguuuugaaucaguagcauggagcgccagugcuugccacgacggcauuaacuggcuuacuauagggaucucuggaccagauuccggugcaguugccgugcugaaguauaauggcauuaucacagacaccauaaagagcuggaaaaacaauauuuugagaacgcaagagucggagugugcuugcgucaacgggucuuguuucacuaucaugaccgauggacccuccgacggccaggccucauacaagaucuuuaggauugaaaaagguaagaucgugaaaaguguggagaugaaugcgccuaacuaucauuacgaagagugcagcuguuacccagauuccucugagauuacaugcgucugccgggacaauuggcacgggagcaaccgcccguggguuucauucaaucagaaccucgaauaucagauaggauacaucuguaguggcguguuuggcgauaaucccagaccuaacgacaagacuggguccugcggaccaguaagcucuaauggugcaaacggcgugaagggguucucauuuaaauauggaaauggcgucuggauugguaggaccaagaguaucagcucccggaaaggguucgagaugaucugggaucccaacggcuggacaggaaccgacaacaauuuuucuauuaagcaagacauagugggcaucaacgaauggucgggguacagcggauccuucguucagcauccugagcugacgggucuggauuguauucgcccaugcuucuggguggaacucauccgaggcagacccaaagagaauacuauuuggacaucagggaguucuaucagcuuuuguggagucaacuccgacaccgugggcuggucauggccggauggugccgaguuaccuuucacuauagacaaguga

SEQ ID NO: 147715 - RNA, 1410 nt, Artificial Sequence; identical to SEQ ID NO: 147653
  derived and/or modified sequence opt3 from neuraminidase__InfluenzaA__AIL94688

SEQ ID NO: 147716 - RNA, 1410 nt, Artificial Sequence
  derived and/or modified sequence opt3 from neuraminidase__InfluenzaA__AIL94700
augaaccccaaucagaagaucauuaccauaggcagcgugucccugacaaucucuacuauuugcuucuuuaugcagaucgccauucucaucacgauagucacccuucacuucaaacaguacgaguuuaacucaccuccaaauaaccagguuaugcugugugaaccgacaaucauugagagaaauaucacugaaauuguguauuugaccaacacaaccaucgagaaggaaauaugccccaaaccugcugaguacaggaauuggaguaagccacagugugggauuacuggauucgcacccuuuagcaaagacaacuccauccgguuaucugccgguggcgauauuuggguaacacgcgagccuuaugugucgugcgacccagauaaguguuaccaauucgcgcuggggcagggaaccacgcuaaauaacguccauucaaauaacacugugcgagaccguacccccuauagaacacuccugaugaaugaacuuggcguuccuuuucaccuggguacuaaacaggugugcaucgcuuggagcaguuccucuugucaugaugggaaggccugguugcacgucugcaucaccggagacgauaagaacgcaacagccagcuucauuuacaauggcaggcucguggacuccguaguuucauggaguaaagagauacugcggacccaggaaagcgagugugugugcaucaacggcacguguacugucgugaugacagaugggucugcuuccggaaaggcagacaccaaaauucuguuuaucgaggaagguaagauagugcauauuucaacucucagcggcagugcccaacacgucgaggaaugcucuugcuauccacgcuacccggggguuagaugugugugcagggauaacuggaagggauccaaucggcccaucguagacaucaacauugaggaucacagcaucgugucgucuuacgucuguuccggcuuagugggugacacaccucgcaaaaaugacucaaguagcuccucucauugccuggauccaaacaaugaagaagggggacacggcguuaagggcugggcuuucgacgaugggaacgacguguggaugggacgaaccauuaaugagacgagcagacuugguuaugagaccuuuaaagucauagagggcuggucaaaccccaagaguaaauugcagaucaauaggcaagugauuguagaucguggggaccgguccggauacagcggcaucuucucuguugaagguaagucauguaucaaccgcugcuuuuauguggagcugauuagagggaggaaagaagagacagagguccuauggaccaguaauagcauaguggucuucuguggcacuuccggaacauacggcacugggucuuggccugauggagccgaccucaaccugaugccaaucuga

SEQ ID NO: 147717 - RNA, 1410 nt, Artificial Sequence; identical to SEQ ID NO: 147662
  derived and/or modified sequence opt3 from neuraminidase__InfluenzaA__AIL94712

SEQ ID NO: 147718 - RNA, 1410 nt, Artificial Sequence; identical to SEQ ID NO: 147692
  derived and/or modified sequence opt3 from neuraminidase__InfluenzaA__AIL94723

SEQ ID NO: 147719 - RNA, 1410 nt, Artificial Sequence
  derived and/or modified sequence opt3 from neuraminidase__InfluenzaA__AIL94734
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacgaacauucaaauaacaccguccgagaccguacacccuauagaacucuccugaugaaugagcuuggcgugccuuuucaccuggguaccaagcagguuugcauugcuuggagcaguuccucuugucaugaugggaaagccugguugcacgugugcaucacaggagacgauaagaacgcaaccgccagcuucaucuacaauggcaggcucgucgacuccgugguaucauggaguaaagaaauucugcggacgcaggagagcgaguguguuugcauaaacggcacuuguacaguggucaugaccgaugggucugcuuccggaaaggcagacacuaaaauccuguuuauugaagaggguaagaucgugcauauaucaacacucagcggcagugcccaacacguggaagagugcucuugcuauccacgcuacccgggggucagauguguuugcagggauaacuggaagggauccaaucggcccauuguggacaucaacaucaaagaucacagcauuguaucgucuuacguguguuccggcuuagucggugacaccccucgcaagaaugacucaaguagcuccucucauugccuggauccaaacaaugaagaagggggacacggcgugaaaggcugggcuuucgacgaugggaacgacguuuggaugggacgaacgaucaaugagaccagcagacuugguuaugagacauuuaaggugauugagggcuggucaaaccccaaaaguaaguugcagauaaauaggcaggucaucguggaucguggggaccgguccggauacagcggcauuuucucuguagaagguaaaucauguaucaaccgcugcuuuuauguugagcugaucagagggaggaaggaagagacugaggugcuauggaccaguaauagcauugucguguucuguggcacauccggaacuuacggcaccgggucuuggccugauggagccgaccucaaccugaugccaauauga

SEQ ID NO: 147720 - RNA, 1410 nt, Artificial Sequence; identical to SEQ ID NO: 147662
  derived and/or modified sequence opt3 from neuraminidase__InfluenzaA__AIL94746

SEQ ID NO: 147721 - RNA, 1410 nt, Artificial Sequence; identical to SEQ ID NO: 147692
  derived and/or modified sequence opt3 from neuraminidase__InfluenzaA__AIL94757

SEQ ID NO: 147722 - RNA, 1410 nt, Artificial Sequence; identical to SEQ ID NO: 147653
  derived and/or modified sequence opt3 from neuraminidase__InfluenzaA__AIL94768

SEQ ID NO: 147723 - RNA, 1410 nt, Artificial Sequence; identical to SEQ ID NO: 144162
  derived and/or modified sequence opt3 from neuraminidase__InfluenzaA__AIL94780

SEQ ID NO: 147724 - RNA, 1410 nt, Artificial Sequence; identical to SEQ ID NO: 147692
  derived and/or modified sequence opt3 from neuraminidase__InfluenzaA__AIL94803

SEQ ID NO: 147725 - RNA, 1410 nt, Artificial Sequence; identical to SEQ ID NO: 147672
  derived and/or modified sequence opt3 from neuraminidase__InfluenzaA__AIL94814

SEQ ID NO: 147726 - RNA, 1410 nt, Artificial Sequence
  derived and/or modified sequence opt3 from neuraminidase__InfluenzaA__AIL94826
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacccgcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacguccauucaaauaacaccgcucgagaccguacaccauauagaacucugcuuaugaaugaacugggcgugcccuuucacuuggguaccaagcagguuugcauugccuggagcaguuccucuugucaugaugggaaagcauggcuccacgugugcaucacaggagacgauaagaacgccaccgcuagcuucaucuacaauggcaggcuggucgacuccgugguaucauggaguaaagagauucugcggacgcaggaaagcgaguguguuugcauaaacggcacuuguacaguggucaugaccgaugggucugcauccggaaaggccgacacuaaaauccucuuuauugaggaagguaagaucgugcauacaucaaccuuaagcggcagugcucaacacguggaggaaugcucuugcuauccucgcuacccaggggucagauguguuugcagggauaacuggaagggauccaaucggccgauaguggacauuaacaucaaagaucacagcaucguaucgucuuacguguguuccggccuggucggugacacgccccgcaagaaugacucaaguagcuccucucauugccuuaacccuaauaacgaggaagggggacacggcgugaaaggcugggccuucgaugacgggaaugauguuuggaugggacgaaccauuaacgagacaagcagauuggguuaugagacuuuuaaggugaucgaaggcuggucaaauccaaaaaguaagcugcagauuaacaggcaggucauaguggaccguggggaucgguccggauacagcggcaucuucucuguagaggguaaaucauguauuaaucgcugcuuuuauguugaacuaaucagagggaggaaggaggaaaccgaggugcucuggacaaguaacagcaucgucguguucuguggcacuuccggaaccuacggcacagggucuuggcccgacggagcggaucugaaucuuaugccuauuuga

SEQ ID NO: 147727 - RNA, 1410 nt, Artificial Sequence
  derived and/or modified sequence opt3 from neuraminidase__InfluenzaA__AIL94850
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcuguucgaaccgacuauaaucgagagaaauauuaccgaaaucguguauuugacaaacaccacuauugagaaggaaaucugucccaaauuagcugaguacaggaauuggaguaagccucagugcgacauaacaggguuugcaccauucagcaaagauaacuccauucggcugucugccggaggugacaucuggguaacccgcgagcccuaugugucgugugauccugacaagugcuaccaauuugcgcuaggccaggggacgacucucaauaacguccauucaaaugauaccgugcgagaccguacaccauauagaacucugcuuaugaacgaacugggaguucccuuccacuugggcaccaaacagguguguauugcuuggagcaguuccucuugccaugaugguaaagccuggcuccacgucuguaucacaggggacgauaagaaugcaaccgccagcuuuaucuacaacggaaggcugguggacuccauuguaucauggaguaaagagauacugcggacgcaggaaagcgagugcguuuguaucaauggcacuugcacaguggucaugaccgauggcucugcuuccgggaaggcagacacuaaaauucucuucaucaaggagggaaagauagugcauacaucaaccuuaagcgguagugcccaacacguggaagaguguucuugcuauccucgcuacccaggcgucagaugcguuuguagggauaacuggaaaggguccaaccggccgauuguggacaucaauaucaaggaccacagcauuguaucgucuuacgugugcuccggacuggucggcgauacgccccgcaaaaacgacucaaguagcuccucucauugucuugauccuaauagcgaagagggugggcacggagugaagggcugggcuuuugacgauggcaacgacguuuggauggggcgaaccaucucagaaaagaguagauugggauaugagacauucaaggugauugaggguugguccaauccaaaaagcaaguuucagauaaacaggcaggucaucguggaucggggcaaucguucuggguacucaggaauuuucaguguagaaggcaagagcugcaucaaccgcuguuucuauguugagcugaucagagguaggaaagaagagacugaagugcuauggaccuccaauucuauugucguguuuugcgggacaucgggcacuuacggaaccggcagcuggcccgacggggccgaucucaaccugaugccuauauga

SEQ ID NO: 147728 - RNA, 1410 nt, Artificial Sequence; identical to SEQ ID NO: 141426
  derived and/or modified sequence opt3 from neuraminidase__InfluenzaA__AIL94862

SEQ ID NO: 147729 - RNA, 1410 nt, Artificial Sequence; identical to SEQ ID NO: 141426
  derived and/or modified sequence opt3 from neuraminidase__InfluenzaA__AIL94874

SEQ ID NO: 147730 - RNA, 1410 nt, Artificial Sequence
  derived and/or modified sequence opt3 from neuraminidase__InfluenzaA__AIL94886
augaaccccaaucagaagaucauuaccauaggcagcgugugcaugacaaucgggauggccaaccugaugcuccaaauuggaaauaucauuuccaucuggauaucucacucaauccagcuugguaacaaaaaucagauugagacuuguaaccagagugucaucacguacgaaaauaacaccuggguuaaucaaacauaugugaacauuagcaauacuaacuucgcugcaggccaguccguagugucugucaagaucgccggaaauucgucacugugcccugugagcggaugggcgauauacaguaaagacaacuccauuagaaucggcucuaagggugauguuuuugugauuagggagccauucaucagcuguuccccguuggaaugccggaccuuuuucuuaacacagggggcucugcuaaaugacaaacauucaaacggaaccaucaaggaucgcagucccuaucgaacucucaugagcuguccuauuggcgaggucccaucucccuacaacucccguuuugaaucaguggccuggagcgcaagugccugccacgacggcauaaauuggcugacaaucgggauuucuggaccugaugacggugcuguagcaguucuuaaguauaacggcaucauaaccgauacgauuaaauccuggagaaauaacauccugaggacucaggagagcgagugugccugcgugaaugggucguguuucaccaucaugacagacggaccaucugauggccaggcuuccuacaagauuuuucggaucgaaaaagguaagauugucaaaucaguggagaugaacgcccccaauuaucauuacgaagagugcaguuguuacccugacagcuccgagauaacuugcgugugccgcgauaacuggcacgggucuaauagaccaugggucagcuucaaccaaaauuuggaauaucagaucggauacauuuguucaggcaucuuuggcgacaacccgaggccccaugauaagaccgggaguugcggaccuguuuccagcaauggugcgaacggcgugaagggguucucuuuuaaauauggaaauggcguauggaucggucggacaaagucaauuaguagccgcaaaggguucgagaugauaugggacccaaacggcuggaccggaacggacaacaauuuuuccaucaagcaggauauugugggcaucaacgaauggucuggguacucggggagcuucguccaacaccccgagcucacuggucuggacuguauucgaccuugcuucuggguggaacugaucagaggcaggccaaaagagaauacaauauggaccuccgggucaaguaucucuuuuuguggaguuaacagcgauacugugggcugguccuggcccgacggugcagagcucccguucacaauugauaaguga

SEQ ID NO: 147731 - RNA, 1410 nt, Artificial Sequence; identical to SEQ ID NO: 144938
  derived and/or modified sequence opt3 from neuraminidase__InfluenzaA__AIL94897

SEQ ID NO: 147732 - RNA, 1410 nt, Artificial Sequence; identical to SEQ ID NO: 147726
  derived and/or modified sequence opt3 from neuraminidase__InfluenzaA__AIL94909

SEQ ID NO: 147733 - RNA, 1410 nt, Artificial Sequence; identical to SEQ ID NO: 144162
  derived and/or modified sequence opt3 from neuraminidase__InfluenzaA__AIL94921

SEQ ID NO: 147734 - RNA, 1410 nt, Artificial Sequence; identical to SEQ ID NO: 144162
  derived and/or modified sequence opt3 from neuraminidase__InfluenzaA__AIL94933

SEQ ID NO: 147735 - RNA, 1410 nt, Artificial Sequence; identical to SEQ ID NO: 147653
  derived and/or modified sequence opt3 from neuraminidase__InfluenzaA__AIL94945

SEQ ID NO: 147736 - RNA, 1410 nt, Artificial Sequence
  derived and/or modified sequence opt3 from neuraminidase__InfluenzaA__AIL94957
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaagcgucauuacuuacgaaaacaauacguggguuaaccagaccuaugugaauaucuccaacacaaauuucgcagccggccagucuguagugucggucaaacuggcggggaacaguagcuugugcccugugaguggaugggcuauauacuccaaggacaauucuguuagaauuggcagcaaaggugauguguuugucaucagggagccauucauuuccuguucaccguuagaaugccggaccuuuuuccugacucagggggcccuacucaacgacaagcauaguaauggaacaaucaaagaucgcagccccuaucgaacccugaugucuuguccuaucggcgaggugccaucccccuacaacucacguuuugaaagcguagcauggagugccucugcuugccacgacggcauuaacuggcuuacuauagggaucuccggaccugauagcggugcaguugccgugcugaaguauaauggcauuaucacagacaccauaaagucguggaaaaacaauauuuugagaacgcaagagucugagugugcuugcgucaacggguccuguuucacuaucaugaccgauggaccaucagacggccaggccaguuacaagaucuuuaggauugaaaaagguaagaucgugaaaagcguggagauggaugcgcccaauuaucauuacgaagagugcuccuguuacccugacucuagcgagauuacaugcgucugccgggauaacuggcacgggucaaaucgcccauggguuaguuucaaccagaaucucgaauaucagauaggauacaucuguuccggcguguuuggcgacaacccgagacccaaugauaagacugggagcugcggaccuguaucuucaaacggugcaaauggcgugaagggguucaguuuuaaauauggaaacggcgucuggauugguaggaccaagagcaucuccucucggaaaggguucgagaugaucugggacccaaauggcuggaacggaacagacaacaauuuuucgauuaagcaagauauagugggcaucaacgaauggagcggguacuccggaucauucguucagcaucccgagcugaccggucuggacuguauucgcccuugcuucuggguggaacucauccgaggcagaccaaaagagaauacgauuuggacuucagggucuagcaucuccuuuuguggagucaacucagauacagugggcuggagcuggcccgacggugccgaguuaccguucaccauagauaaguga

SEQ ID NO: 147737 - RNA, 1410 nt, Artificial Sequence; identical to SEQ ID NO: 147726
  derived and/or modified sequence opt3 from neuraminidase__InfluenzaA__AIL94968

SEQ ID NO: 147738 - RNA, 1410 nt, Artificial Sequence
  derived and/or modified sequence opt3 from neuraminidase__InfluenzaA__AIM55840
augaaccccaaucagaagaucauuaccauaggcagcgugugcaugacaaucgggauggccaaccugauucuccaaaucggaaauauuaucuccauauggaucucucacucaauucaggucgguaaccagagucagaucgagauuuguaaucaaagcguuaucacuuacgaaaacaauacgugggugaaccagaccuauguaaauauauccaacacaaauuucgcugcaggccagccuguggucucugugaaacuugccgggaacucgucacugugcccaguuagcggaugggcgauuuacaguaaggacaauuccgugagaaucggcucuaaaggugaugucuuugugauuagggagccguucaucagcuguucccccuuggaaugccggaccuuuuucuuaacucagggggcucugcuaaacgacaagcauucaaauggaacaaucaaagaucgcaguccuuaucgaacccucaugagcuguccaauuggcgagguacccucuccuuacaacucccguuuugaaucaguugccuggagcgcaagugccugccacgacggcauaaacuggcugacuaucgggauuucuggaccagauuccggugcuguggcaguccuuaaguauaauggcaucauaacagacaccauuaagagcuggagaaacgauauccugaggacgcaagagucggagugugccugcgugaaugggucuuguuucacuaucaugaccgacggacccuccgauggccaggcuucauacaaaauuuuucggaucgaaaaggguaaaauugugaagagugucgagaugaacgccccuaauuaucauuucgaagagugcagcuguuacccagacuccucugagauaacaugcguuugccgcgauaacuggcacgggagcaauagaccgugggugucauuuaaccagaauuuggaauaccagaucggauauauuuguaguggcaucuucggcgacaaccccaggccuaaugauaaaacuggguccugcggaccaguaagcucuaacggugcgaauggcgugaagggguuuucauucaaguacggaaacggcgucuggaucggucggaccaaaaguauuagcucccgcaagggguuugagaugauaugggaccccaauggcuggacaggaaccgacaacaacuucucuaucaaacaagauauugugggcaucaaugaauggucgggguauagcggauccuucguucagcauccugagcucacgggucuggacuguauucgaccaugcuuuuggguggaacugaucagaggcaggcccaaggagaacacuauauggacaucagggaguucuaucagcuucuguggagucaauuccgauaccgugggcuggucauggccggacggugcagagcucccuuuuacuauugauaaauga

SEQ ID NO: 147739 - RNA, 1410 nt, Artificial Sequence
  derived and/or modified sequence opt3 from neuraminidase__InfluenzaA__AIM55851
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaagggucgcauugugaaaagugucgagaugaaugccccuaacuaucauuacgaagagugcagcuguuacccagauuccucugagaucacuugcguuugcagagacaauuggcacgggagcaacaggccgugggugucauucaaucagaaccucgaauaucagauuggauacauauguaguggcguauuuggcgauaauccccggccuaacgacaagaccggguccugcggaccagugagcucuaauggugcgaacggcgucaaaggguucucauuuaaguauggaaauggcguguggaucggucgcacaaagaguauuagcucccgaaaaggguucgagaugaucugggaucccaacggcuggaccggaacggacaacaaguuuucuaucaaacaagacauuguuggcauaaaugaauggucgggguacagcggauccuucgugcagcauccugagcugacuggucuggauuguaucagaccaugcuucugggucgaacucauuaggggccggcccgaggagaacacaaucuggaccucagggaguucuauuagcuuuuguggagugaaguccgacacuguaggcuggucauggccggauggugcagaauuaccuuucacaaucgacaaauga

SEQ ID NO: 147740 - RNA, 1410 nt, Artificial Sequence
  derived and/or modified sequence opt3 from neuraminidase__InfluenzaA__AIM55862
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuuaagaucgaaaaagguaagauugugaaaagugucgagaugaaugccccuaacuaucauuacgaagagugcagcuguuacccagauuccucugagaucacuugcguuugccgggacaauuggcacgggagcaaccgcccgugggugucauucaaucagaaccucgaauaucagauuggauacauauguaguggcguauuuggcgauaaucccagaccuaacgacaagaccggguccugcggaccagugagcucuaauggugcgaacggcgucaagggguucucauuuaaauauggaaauggcguguggaucgguaggacaaagaguauuagcucccggaaaggguucgagaugaucugggaucccaacggcuggaacggaaccgacaauaacuuuucuaucaagcaagacauuguuggcauaaaagaauggucgggguacagcggauccuucgugcagcauccugagcugacgggucuggauuguauccgcccaugcuucugggucgaacucauucgaggcagacccgaggagaauacuaucuggacaucagggaguucuauuagcuuuuguggagugaacuccgacaccguaggcuggucauggccggauggugcagaauuaccuuucacuaucgacaaguga

SEQ ID NO: 147741 - RNA, 1410 nt, Artificial Sequence
  derived and/or modified sequence opt3 from neuraminidase__InfluenzaA__AIM55873
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaagacauuguuggcauaaaggaauggucgggguacagcggauccuucgugcagcauccugagcugacuggucuggauuguauccgaccaugcuucugggucgaacucauuagaggcaggcccgaggagaacacaaucuggaccucagggaguucuauuagcuuuuguggaguaaauuccgacacugugggcuggucauggccggauggugcagaauuaccuuucacaaucgacaaauga

SEQ ID NO: 147742 - RNA, 1410 nt, Artificial Sequence; identical to SEQ ID NO: 147741
  derived and/or modified sequence opt3 from neuraminidase__InfluenzaA__AIM55884

SEQ ID NO: 147743 - RNA, 1410 nt, Artificial Sequence; identical to SEQ ID NO: 147741
  derived and/or modified sequence opt3 from neuraminidase__InfluenzaA__AIM55918

SEQ ID NO: 147744 - RNA, 1410 nt, Artificial Sequence
  derived and/or modified sequence opt3 from neuraminidase__InfluenzaA__AIM55929
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcagcuugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuacaggcgagguaccaucccccuacaacucacguuuugaaagcguugccuggagugcaucugccugccacgacggcaucaacuggcuuaccaucgggauuuccggaccugauagcggugcuguggcaguccugaaguauaauggcauaaucacggacacuauuaagucguggagaaacaauaucuugaggacccaagagucugagugugccugcgugaacggguccuguuucacaauaaugacugauggaccaucagacggccaggcuaguuacaaaauuuuucggaucgaaaaggguaaaaucgugaagucagucgagaugaaugcccccaacuaucauuacgaagagugcuccuguuacccugauucuagcgagauuaccugcguuugccgcgacaauuggcacgggucaaacagaccaugggugaguuucaaucagaaccucgaauaucagaucggauacauuuguuccggcguauuuggcgauaauccgaggcccaacgacaaaacagggagcugcggaccugugucuucaaauggugcgaacggcgucaagggguucaguuuuaaguauggaaauggcguguggauaggucggaccaaaagcaucuccucucgcaagggguucgagaugauuugggauccaaacggcuggacgggaacugacaacaauuuuucgaucaaacaagacaucguuggcauuaaggaauggagcggguacuccggaucauucgugcagcaucccgagcugacaggucuggauuguauacgaccuugcuucugggucgaacucaucagaggcaggccagaggagaacaccauuuggacuucagggucuagcaucuccuuuuguggagugaauagugacacaguaggcuggagcuggcccgauggugcagaauuaccguucaccauugacaaauga

SEQ ID NO: 147745 - RNA, 1410 nt, Artificial Sequence
  derived and/or modified sequence opt3 from neuraminidase__InfluenzaA__AIM55940
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccucuacuaacuucgcugcaggccagucgguggucccugugaaacuggccgggaauagcagcuugugcccaguuaguggaugggcgaucuacuccaaggacaacucugugagaauaggcagcaaaggugaugucuuugugauuagggagccguucaucuccuguucacccuuagaaugccggaccuuuuuccugacacagggggcucuacucaaugacaagcauaguaacggaaccauuaaagaucgcagcccuuaucgaacucugaugucuuguccaaucggcgagguacccuccccuuacaauucacguuuugaaagcguugccuggagugcaucugccugccacgacggcaucaacuggcuuacaauugggauauccggaccagauagcggugcuguggcaguccugaaguauaacggcaucauuaccgacacgaucaagucguggagaaauaacauauugaggacucaagagucugagugugccugcgugaauggguccuguuucaccauuaugacagauggacccucagacggccaggcuaguuacaaaaucuuucggaucgaaaaggguaaaauugugaagucagucgagaugaacgccccuaauuaucauuacgaagagugcuccuguuacccagauucuagcgagaucacuugcguuugccgcgacaacuggcacgggucaaauagaccgugggugaguuucaaccagaaucucgaauaucagauuggauacauauguuccggcguauuuggcgauaaccccaggccuaaugacaaaaccgggagcugcggaccagugucuucaaacggugcgaauggcgucaagggguucaguuuuaaguauggaaacggcguguggaucggucggacaaaaagcauuuccucucgcaagggguucgagaugaucugggaucccaauggcuggaccggaacggacaacaacuuuucgaucaaacaagacauuguuggcauaaaggaauggagcggguacuccggaucauucgugcagcauccugagcugacuggucuggauuguauccgaccaugcuucugggucgaacucauuagaggcaggcccgaggagaauacaaucuggaccagugggucuagcauuuccuuuuguggagugaacucagacacuguaggcuggagcuggccggauggugcagaauuaccuuucacaaucgacaaauga

SEQ ID NO: 147746 - RNA, 1410 nt, Artificial Sequence
  derived and/or modified sequence opt3 from neuraminidase__InfluenzaA__AIM55965
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaagacauuguuggcauaaaggaauggucgggguacagcggauccuucgugcagcauccugagcugacuggucuggauuguauccgaccaugcuucugggucgaacucauuagaggcaggcccgaggagaacacaaucuggaccucagggaguucuauuagcuuuuguggaguaaauuccgacgcagugggcuggucauggccggauggugccgaauuaccuuucacuaucgacaaauga

SEQ ID NO: 147747 - RNA, 1410 nt, Artificial Sequence
  derived and/or modified sequence opt3 from neuraminidase__InfluenzaA__AIM55976
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacucaucauugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuaucggcgagguaccaucccccuacaacucacguuuugaaagcguugccuggagugcaucugccugccacgacggcaucaacuggcuuacaauugggauauccggaccugauagcggugcuguggcaguccugaaguauaauggcaucauuaccgacacgaucaagucguggagaaacaauauauugaggacucaagagucugagugugccugcgugaacggguccuguuucaccauuaugacagauggaccaucagacggccaggcuaguuacaaaaucuuucggaucgaaaaggguaaaauugucaagagcguggagaugaaugcccccaacuaucauuacgaagagugcuccuguuacccugauucuagcgagaucacuugcguuugccgcgacaauuggcacgggucaaacagaccaugggugaguuucaaucagaaccucgaauaucagauuggauacauauguuccggcguauuuggcgauaauccgaggcccaacgacaaaaccgggagcugcggaccugugucuucaaauggugcgaacggcgucaagggguucaguuuuaaguauggaaauggcguguggaucggucggacaaaaagcauuuccucucgcaagggguucgagaugaucugggauccaaacggcuggaccggaacggacaacaauuuuucgaucaaacaagacauuguuggcauaaaggaauggagcggguacuccggaucauucgugcagcaucccgagcugacuggucuggauuguauccgaccuugcuucugggucgaacucauuagaggcaggccagaggagaacacaaucuggaccagugggucuagcauuuccuuuuguggagugaauagcgacacuguaggcuggagcuggcccgauggugcagaauuaccguucacaaucgacaaauga

SEQ ID NO: 147748 - RNA, 1410 nt, Artificial Sequence
  derived and/or modified sequence opt3 from neuraminidase__InfluenzaA__AIM55987
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcagcuugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuacaggcgagguaccaucccccuacaacucacguuuugaaagcguugccuggagugcaucugccugccacgacggcaucaacuggcuuaccaucgggauuuccggaccugauagcggugcuguggcaguccugaaguauaauggcauaaucacggacacuauuaagucguggagaaacaauaucuugaggacccaagagucugagugugccugcgugaacggguccuguuucacaauaaugacugauggaccaucagacggccaggcuaguuacaaaauuuuucggaucgaaaaggguaaaaucgugaagucagucgagaugaaugcccccaacuaucauuacgaagagugcuccuguuacccugauucuagcgagauuaccugcguuugccgcgacaauuggcacgggucaaacagaccaugggugaguuucaaucagaaccucgaauaucagaucggauacauuuguuccggcguauuuggcgauaauccgaggcccaacgacaaaacagggagcugcggaccugugucuucaaauggugcgaacggcgucaagggguucaguuuuaaguauggaaauggcguguggauaggucggaccaaaagcaucuccucucgcaagggguucgagaugauuugggauccaaacggcuggacgggaacugacaacaauuuuucgaucaaacaagacaucguuggcauuaaggaauggagcggguacuccggaucauucgugcagcaucccgagcugacaggucuggauuguauacgaccuugcuucugggucgaacucaucagaggcaggccagaggagaacaccauuuggacuucagggucuagcaucuccuuuuguggagugaauagugacacaguagauuggagcuggcccgacggcgcagaauuaccguucaccauugauaaauga

SEQ ID NO: 147749 - RNA, 1410 nt, Artificial Sequence
  derived and/or modified sequence opt3 from neuraminidase__InfluenzaA__AIM55998
augaaccccaaucagaagaucauuaccauaggcagcgugugcaugacaaucgggauggccaaccugauucuccaaaucggaaauacuauuuccaucugggucucucacucaauacagcuugguaaccagagucagaucgagacguguaaucaaagcguuauuaccuacgaaaacaauacaugggugaaccagacuuauguaaauaucuccaacaccaauuucgcugcaggccagucuguggucccugugaaacuggccgggaacucgucauugugcccaguuagcggaugggcgauuuacaguaaggacaauuccgugagaaucggcucuaaaggugaugucuuugugauaagggagccguucauuagcuguucccccuuagaaugccggacauuuuuccugacccagggggcucuacucaacgacaagcauucaaauggaacuaucaaagaucgcaguccuuaucgaacacugaugagcuguccaauuggcgagguacccucuccuuacaacucccguuuugaaucaguugccuggagcgcaagugccugccacgacggcaucaacuggcuuaccaucgggauuucuggaccagauuccggugcuguggcaguccugaaguauaauggcauaaucacggacacuauuaagagcuggagaaacaauaucuugaggacccaagagucggagugugccugcgugaacgggucuuguuucacaauaaugacugauggacccuccgacggccaggcuucauacaaaauuuuucggaucgaaaaggguaaaaucgugaagagugucgagaugaaugccccuaacuaucauuacgaagagugcagcuguuacccagauuccucugagauuaccugcguuugccgcgacaauuggcacgggagcaacagaccgugggugucauucaaucagaaccucgaauaucagaucggauacauuuguaguggcguauuuggcgauaaucccaggccuaacgacaaaacaggguccugcggaccagugagcucuaauggugcgaacggcgucaagggguucucauuuaaguauggaaauggcguguggauaggucggaccaaaaguaucagcucccgcaagggguucgagaugauuugggaucccaacggcuggacgggaacugacaacaaauuuucuaucaagcaagacaucguuggcauuaaugaauggucgggguacagcggauccuucgugcagcauccugagcugacaggucuggauuguauacgaccaugcuucugggucgaacucaucagaggcaggcccgaggagaacaccauuuggacuucagggaguucuaucagcuuuuguggagugaaauccgacacaguaggcuggucauggccggauggugcagaauuaccuuucaccauugacaaguga

SEQ ID NO: 147750 - RNA, 1410 nt, Artificial Sequence; identical to SEQ ID NO: 147747
  derived and/or modified sequence opt3 from neuraminidase__InfluenzaA__AIM56009

SEQ ID NO: 147751 - RNA, 1410 nt, Artificial Sequence; identical to SEQ ID NO: 147747
  derived and/or modified sequence opt3 from neuraminidase__InfluenzaA__AIM56020

SEQ ID NO: 147752 - RNA, 1410 nt, Artificial Sequence; identical to SEQ ID NO: 147747
  derived and/or modified sequence opt3 from neuraminidase__InfluenzaA__AIM56031

SEQ ID NO: 147753 - RNA, 1410 nt, Artificial Sequence
  derived and/or modified sequence opt3 from neuraminidase__InfluenzaA__AIM56042
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccaauggccaggcuucauacaaaaucuuucggaucgaaaaggguaaaauugugaagagugucgagaugaacgccccuaauuaucauuacgaagagugcagcuguuacccagacuccucugagaucacuugcguuugccgcgauaacuggcacgggagcaauagaccgugggugucauucaaccagaaucucgaauaucagauuggauacauauguaguggcguauuuggcgacaaccccaggccuaaugauaaaaccggguccugcggaccagugagcucuaacggugcgaauggcgucaagggguucucauuuaaguauggaaacggcguguggaucggucggacaaaaaguauuagcucccgcaagggguucgagaugaucugggaccccaacggcuggaccggaacggauaauaacuuuucuaucaaacaagacauuguuggcauaaaggaauggucgggguacagcggauccuucgugcagcauccugagcugacuggucuggacuguauccgaccaugcuucugggucgaacucauuagaggcaggcccgaggagaauacaaucuggaccucagggaguucuauuagcuuuuguggagugaacuccgauacuguaggcuggucauggccggacggugcagaauuaccuuucacaaucgauaaauga

SEQ ID NO: 147754 - RNA, 1410 nt, Artificial Sequence
  derived and/or modified sequence opt3 from neuraminidase__InfluenzaA__AIM56053
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacucaucauugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuaucggcgagguaccaucccccuacaacucacguuuugaaagcguugccuggagugcaucugccugccacgacggcaucaacuggcuuacaauugggauauccggaccugauagcggugcuguggcaguccugaaguauaauggcaucauuaccgacacgaucaagucguggagaaacaauauauugaggacucaagagucugagugugccugcgugaacggguccuguuucaccauuaugacagauggaccaucagacgaacaggcuaguuacaaaaucuuucggaucgagaagggcaaaauugucaagagcguggaaaugaaugcccccaacuaucauuacgaggagugcuccuguuacccugauucuagcgaaaucacuugcguuugccgcgacaauuggcacgguucaaacagaccaugggugaguuucaaucagaaccucgaguaucagauuggguacauauguuccggaguauuuggcgauaauccgaggcccaacgacaaaaccggcagcugcgggccugugucuucaaauggagcgaacggugucaagggcuucaguuuuaaguaugggaauggaguguggaucggccggacaaaaagcauuuccucucgcaaggguuucgaaaugaucugggauccaaacggguggaccggcacggacaacaauuuuucgaucaaacaagacauuguuggaauaaaggaguggagcggcuacuccgggucauucgugcagcaucccgaacugacuggacuggauuguauccgaccuugcuucugggucgagcucauuagagguaggccagaggaaaacacaaucuggaccaguggcucuagcauuuccuuuuguggggugaauagcgacacuguaggauggagcuggcccgauggcgcagaguuaccguucacaaucgacaaauga

SEQ ID NO: 147755 - RNA, 1410 nt, Artificial Sequence
  derived and/or modified sequence opt3 from neuraminidase__InfluenzaA__AIM56064
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaagacauuguuggcauaaaggaauggucgggguacagcggauccuucgugcagcauccugagcugacuggucuggauuguauccgaccaugcuucugggucgaacucgugagaggcaggcccgaggagaacacaauuuggaccucagggaguucuaucagcuuuuguggaguaaauuccgacacuguuggcuggucauggccggauggugcagaauuaccuuucacaauugacaaauga

SEQ ID NO: 147756 - RNA, 1410 nt, Artificial Sequence
  derived and/or modified sequence opt3 from neuraminidase__InfluenzaA__AIM56086
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcacucaaauggaaccauuaaagaucgcaguccuuaucgaacucugaugagcuguccaaucggcgagguacccucuccuuacaacucccguuuugaaucaguugccuggagcgcaagugccugccaugacggcaucaacuggcuuacaauugggauaucuggaccagauaauggugcuguggcaguccugaaguauaacggcaucauuaccgacacgaucaaguccuggagaaauaacauauugaggacucaggagagcgagugugccugcgugaaugggucguguuucaccauuaugacagauggacccucugacggccaggcuuccuacaaaaucuuucggaucgaaaaggguaaaauugugaagucagucgagaugaacgccccuaauuaucacuacgaagagugcaguuguuacccagauagcuccgagaucacuugcguuugccgcgacaacuggcaugggucuaauagaccgugggugagcuucaaccaaaaucucgaauaucagauuggauacauauguucaggcguauuuggcgauaaccccaggccuaaugacaaaaccgggaguugcggaccagugacauccaacggugcgaauggcgucaagggguucagcuuuaaguauggaaacggcguguggaucggucggaccaaaucuauuucaagucgcaagggguucgagaugaucugggaucccaacggcuggacgggaacugacaauaacuuuagcaucaaacaggacauuauaggcaucaaggaaugguccggguacucuggaucguucguucaacacccugagcugacaggucuggauuguauucgaccaugcuucuggguggaacucaucagaggcaggcccgaggagaauaccauuuggacuagcggguccucaaucaguuuuuguggagucaacucugacacagugggcuggagcuggccggauggugcagaauuaccuuucaccauagacaaauga

SEQ ID NO: 147757 - RNA, 1410 nt, Artificial Sequence
  derived and/or modified sequence opt3 from neuraminidase__InfluenzaA__AIM56097
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcagagcagucuguggucucggugaaacuggccggcaacucaucauugugcccuguuagugggugggcgaucuacuccaaggacaauucugugagaauaggaagcaaaggcgaugucuuugugauuagggaaccauucaucuccuguucaccguuagagugccggaccuuuuuccugacacagggugcucuacucaacgacaagcauaguaaugggaccauuaaagaucgcagccccuaucgaacucugaugucuuguccuaucggagaaguaccaucccccuacaacucacguuuugagagcguugccuggagugcaucugccugccacgacggcaucaacuggcuuacaauuggcauauccgggccugauagcggagcuguggcaguccugaaguauaaugguaucauuaccgacacgaucaagucguggagaaacaauauauugaggacucaagagucugaaugugccugcgugaacggcuccuguuucaccauuaugacagaugggccaucagacggacaggcuaguuacaaaaucuuucggaucgagaagggcaaaauugucaagagcguggaaaugaaugcccccaacuaucauuacgaggagugcuccuguuacccugauucuagcgaaaucacuugcguuugccgcgacaauuggcacgguucaaacagaccaugggugaguuucaaucagaaccucgaguaucagauuggguacauauguuccggaguauuuggcgauaauccgaggcccaacgacaaaaccggcagcugcgggccugugucuucaaauggagcgaacggugucaagggcuucaguuuuaaguaugggaauggaguguggaucggccggacaaaaagcauuuccucucgcaaggguuucgaaaugaucugggauccaaacggguggaccggcacggacaacaauuuuucgaucaaacaagacauuguuggaauaaaggaguggagcggcuacuccgggucauucgugcagcaucccgaacugacuggacuggauuguauccgaccuugcuucugggucgagcucauuagagguaggccagaggaaaacacaaucuggaccaguggcucuagcauuuccuuuuguggggugaauagcgacacuguaggauggagcuggcccgauggcgcagaguuaccguucacaaucgacaaauga

SEQ ID NO: 147758 - RNA, 1410 nt, Artificial Sequence
  derived and/or modified sequence opt3 from neuraminidase__InfluenzaA__AIM56108
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccuggauuaaccagacauaugugaauaucuccaacacuaauuucgcugcaggccagucuguagugccugucaaacuggccgggaacucgucauugugcccagugagcggaugggcgauauacaguaaggacaauuccguuagaauuggcucuaaaggugauguguuugucaucagggagccguucauuagcuguucccccuuagaaugccggaccuuuuuccugacacagggggcucuacucaacgacaagcauucaaauggaaccaucaaagaucgcaguccuuaucgaacucugaugagcuguccaaucggcgaggugcccucuccuuacaacucccguuuugaaucaguagccuggagcgcaagugccugccacgacggcauuaacuggcuuacaauagggaucucuggaccagauuccggugcuguugcagugcugaaguauaauggcauuaucaccgacacgauaaagagcuggagaaacaauauuuugaggacucaagagucggagugugccugcgucaacgggucuuguuucaccaucaugacagauggacccuccgacggccaggcuucauacaaaaucuuucggauugaaaaggguaaaaucgugaagaguguggagaugaaugccccuaacuaucauuacgaagagugcagcuguuacccagauuccucugagauuacuugcgucugccgcgacaauuggcacgggagcaacagaccguggguuucauucaaucagaaccucgaauaucagauaggauacaucuguaguggcguguuuggcgauaaucccaggccuaacgacaaaaccggguccugcggaccaguaagcucuaauggugcgaacggcgugaagggguucucauuuaaguauggaaauggcgucuggauuggucggacaaaaaguaucagcucccgcaagggguucgagaugaucugggaucccaacggcuggaccggaacggacaacaauuuuucuauuaaacaagacauagugggcaucaaggaauggucgggguacagcggauccuucguucagcauccugagcugacuggucuggauuguauucgaccaugcuucuggguggaacucaucagaggcaggcccgaggagaacacaauuuggaccucagggaguucuaucagcuuuuguggagucaauuccgacacugugggcuggucauggccggauggugcagaauuaccuuucacaauagacaaauga

SEQ ID NO: 147759 - RNA, 1410 nt, Artificial Sequence
  derived and/or modified sequence opt3 from neuraminidase__InfluenzaA__AIM56119
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgugaagucagucgagaugaaugcccccaacuaucauuacgaagagugcuccuguuacccugauucuagcgagauuacuugcguuugccgcgacaauuggcacgggucaaacagaccaugggugaguuucaaucagaacuuggaauaucagauaggauacaucuguuccggcguauuuggcgauaauccgaggcccaacgacaaaaccgggagcugcggaccugugucuucaaauggugcgaacggcgucaagggguucaguuuuaaguauggaaauggcguguggauuggucggacaaaaagcaucuccucucgcaagggguucgagaugaucugggauccaaacggcuggaccggaacggacaacaaauuuucgauuaagcaagacauaguuggcaucaaugaauggagcggguacuccggaucauucgugcagcaucccgagcucacuggucuggauuguauucgaccuugcuucugggucgaacugaucagaggcaggccagaggagaacacaauuuggaccagugggucuagcaucuccuuuuguggagugaauagcgacacuguaggcuggagcuggcccgauggugcagaacucccguucacaauagacaaauga

SEQ ID NO: 147760 - RNA, 1410 nt, Artificial Sequence
  derived and/or modified sequence opt3 from neuraminidase__InfluenzaA__AIM56130
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaaauuuucuaucaagcaagacauuguuggcauaaaugaauggucgggguacagcggauccuucgugcagcauccugagcugacuggucuggauuguauccgaccaugcuucugggucgaacucauuagaggcaggcccgaggagaacacaaucuggaccucagggaguucuauuagcuuuuguggagugaaauccgacacuguaggcuggucauggccggauggugcagaauuaccuuucacaaucgacaaguga

SEQ ID NO: 147761 - RNA, 1410 nt, Artificial Sequence
  derived and/or modified sequence opt3 from neuraminidase__InfluenzaA__AIM56141
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucauuuacgaaaacaauacgugggugaaccagaccuauguaaauaucuccaacacaaauuucgcugcaggccagucuguggucucggugaaacuggccgggaacucaucauugugcccuguuaguggaugggcgauauacuccaaggacaauucugugagaauuggcagcaaaggugaugucuuugugaucagggagccauucauuuccuguucaccguuagaaugccggaccuuuuuccugacucagggggcucuacucaacgacaagcauaguaauggaacaaucaaagaucgcagccccuaucgaacccugaugucuuguccuaucggcgagguaccaucccccuacaacucacguuuugaaagcguugccuggagugcaucugccugccacgacggcauuaacuggcuuacuauagggaucuccggaccugauagcggugcuguggcaguccugaaguauaauggcauuaucacagacaccauaaagucguggagaaacaauauuuugaggacgcaagagucugagugugccugcgugaacggguccuguuucacuaucaugaccgauggaccaucagacggccaggcuaguuacaaaaucuuucggauugaaaaggguaaaaucgucaagagcguggagaugaaugcccccaacuaucauuacgaagagugcuccuguuacccugauucuagcgagauuacaugcguuugccgcgacaauuggcacgggucaaacagaccaugggugaguuucaaucagaaccucgaauaucagauaggauacaucuguuccggcguauuuggcgauaauccgaggcccaacgacaaaacugggagcugcggaccugugucuucaaauggugcgaacggcgucaagggguucaguuuuaaguauggaaauggcguguggauuggucggaccaaaagcaucuccucucgcaagggguucgagaugaucugggauccaaacggcuggacaggaaccgacaacaauuuuucgauuaaacaagacauaguuggcaucaaggaauggagcggguacuccggaucauucgugcagcaucccgagcugacgggucuggauuguauucgaccuugcuucugggucgaacucaucagaggcaggccagaggagaacacuauuuggacaagugggucuagcaucuccuuuuguggagugaauagcgacaccguaggcuggagcuggcccgauggugcagaauuaccguucacuauagacaaauga

SEQ ID NO: 147762 - RNA, 1410 nt, Artificial Sequence; identical to SEQ ID NO: 147747
  derived and/or modified sequence opt3 from neuraminidase__InfluenzaA__AIM56152

SEQ ID NO: 147763 - RNA, 1410 nt, Artificial Sequence
  derived and/or modified sequence opt3 from neuraminidase__InfluenzaA__AIM56163
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcacucaaauggaaccauuaaagaucgcaguccuuaucgaacucugaugagcuguccaaucggcgagguacccucuccuuacaacucccguuuugaaucaguugccuggagcgcaagugccugccaugacggcaucaacuggcuuacaauugggauaucuggaccagauaauggugcuguggcaguccugaaguauaacggcaucauuaccgacacgaucaaguccuggagaaauaacauauugaggacucaggagagcgagugugccugcgugaaugggucguguuucaccauuaugacagauggacccucugacggccaggcuuccuacaaaaucuuucggaucgaaaaggguaaaauugugaagucagucgagaugaacgccccuaauuaucacuacgaagagugcaguuguuacccagauagcuccgagaucacuugcguuugccgcgacaacuggcaugggucuaauagaccgugggugagcuucaaccaaaaucucgaauaucagauuggauacauauguucaggcguauuuggcgauaaccccaggccuaaugacaaaaccgggaguugcggaccagugacauccaacggugcgaauggcgucaagggguucagcuuuaaguauggaaacggcguguggaucggucggaccaaaucuauuucaagucgcaagggguucgagaugaucugggaucccaacggcuggacgggaacugacaauaacuuuagcaucaaacaggacauuguuggcauaaaggaaugguccggguacucuggaucguucgugcaacacccugagcugacaggucuggauuguauccgaccaugcuucugggucgaacucauuagaggcaggcccgaggagaauaccaucuggacuagcggguccucaauuaguuuuuguggagugaacucugacacaguaggcuggagcuggccggauggugcagaauuaccuuucaccaucgacaaauga

SEQ ID NO: 147764 - RNA, 1410 nt, Artificial Sequence
  derived and/or modified sequence opt3 from neuraminidase__InfluenzaA__AIM56174
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaagacauuguuggcauaaaggaauggucgggguacagcggauccuucgugcagcauccugagcugacuggucuggauuguauccgaccaugcuucugggucgaacucauuagaggcaggcccgaggagaacacaaucuggaccucagggaguucuauuagcuuuuguggaguaaauuccgacacugugggcuggucauggccggauggugcagaauuaccuuucacaguugacaaauga

SEQ ID NO: 147765 - RNA, 1410 nt, Artificial Sequence; identical to SEQ ID NO: 147760
  derived and/or modified sequence opt3 from neuraminidase__InfluenzaA__AIM56185

SEQ ID NO: 147766 - RNA, 1410 nt, Artificial Sequence; identical to SEQ ID NO: 147759
  derived and/or modified sequence opt3 from neuraminidase__InfluenzaA__AIM56196

SEQ ID NO: 147767 - RNA, 1410 nt, Artificial Sequence; identical to SEQ ID NO: 147741
  derived and/or modified sequence opt3 from neuraminidase__InfluenzaA__AIM56207

SEQ ID NO: 147768 - RNA, 1410 nt, Artificial Sequence
  derived and/or modified sequence opt3 from neuraminidase__InfluenzaA__AIM56229
augaaccccaaucagaagaucauuaccauaggcagcgugugcaugacaaucgggauggccaaccugauucuccaaaucggaaauacuauuuccaucugggucucucacucaauacagaucgguaaccagagucagauugagacguguaaucaaagcguuaucaccuacgaaaacaauacaugggugaaccagacuuauguaaauauuuccaacaccaauuucgcugcaggccagucuguggucucggugaaacuugccgggaacucaagccugugcccuguuaguggaugggcgaucuacuccaaggacaauucugugagaauaggcagcaaaggugaugucuuugugauuagggagccauucaucuccuguucaccguuggaaugccggacauuuuucuuaacccagggggcucugcuaaacgacaagcauaguaauggaacuauuaaagaucgcagccccuaucgaacacucaugucuuguccuaucggcgagguaccaucccccuacaacucacguuuugaaagcguugccuggagugcaucugccugccacgacggcaucaacuggcugaccauugggauauccggaccugauagcggugcuguggcaguccuuaaguauaauggcaucauuacggacacuaucaagucguggagaaacaauauacugaggacccaagagucugagugugccugcgugaacggguccuguuucacaauuaugacugauggaccaucagacggccaugcuaguuacaaaaucuuucggaucgaaaaggguaaaauugugaagucagucgagaugaaugcccccaacuaucacuacgaagagugcuccuguuacccugauucuagcgagaucacuugcguuugccgcgacaauuggcaugggucaaacagaccaugggugaguuucaaucagaacuuggaauaucagauuggauacauauguuccggcguauuuggcgauaauccgaggcccaacgacaaaacagggagcugcggaccugugucuucaaauggugcgaacggcgucaagggguucaguuuuaaguauggaaauggcguguggaucggucggaccaaaagcauuuccucucgcaagggguucgagaugaucugggauccaaacggcuggacgggaacugacaacaaauuuucgaucaagcaggacauuguuggcauaaaugaauggagcggguacuccggaucauucgugcaacaccccgagcucacaggucuggauuguauccgaccuugcuucugggucgaacugauuagaggcaggccagaggagaacaccaucuggaccagugggucuagcauuuccuuuuguggagugaauagcgacacaguaggcuggagcuggcccgauggugcagaacucccguucaccaucgacaaauga

SEQ ID NO: 147769 - RNA, 1410 nt, Artificial Sequence
  derived and/or modified sequence opt3 from neuraminidase__InfluenzaA__AIM56240
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaauuucgcugcaggccagccuguggucucugugaaacuugccgggaacucgucacugugcagcguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacgauauucugaggacucaagagucugagugugccugcgugaauggguccuguuucaccaucaugacagacggaccaucagauggccaggcuaguuacaaaaucuuucggauugaaaaggguaaaaucgucaagagcguggagaugaacgcccccaauuaucauuacgaagagugcuccuguuacccugacucuagcgagauuacuugcguuugccgcgauaacuggcacgggucaaauagaccaugggugaguuucaaccagaauuuggaauaucagauaggauacaucuguuccggcauuuuuggcgacaacccgaggcccaaugauaaaaccgggagcugcggaccuguaucuucaaacggugcgaauggcgugaagggguucaguuuuaaguauggaaacggcgucuggaucggucggacaaaaagcaucuccucucgcaagggguucgagaugauuugggacccaaauggcuggaccggaacggacaacaacuuuucgauaaaacaagauaucgugggcauuaaugaauggagcggguacuccggaucauucguucagcaucccgagcucacuggucuggacuguauccgaccuugcuucuggguggaacugauuagaggcaggccaaaggagaacacaaucuggaccagugggucuagcauauccuuuuguggagucaauucagauacugugggcuggagcuggcccgacggugcagagcucccguucacaaucgauaaauga

SEQ ID NO: 147770 - RNA, 1410 nt, Artificial Sequence
  derived and/or modified sequence opt3 from neuraminidase__InfluenzaA__AIM56251
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcacucaaauggaaccauuaaagaucgcaguccuuaucgaacucugaugagcuguccaaucggcgagguacccucuccuuacaacucccguuuugaaucaguugccuggagcgcaagugccugccaugacggcaucaacuggcuuacaauugggauaucuggaccagauuccggugcuguggcaguccugaaguauaauggcaucauuaccgacacgaucaagagcuggagaaacaauauauugaggacucaggagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucacuacgaagagugcagcuguuacccagauuccucugagaucacuugcguuugccgcgacaauuggcaugggagcaacagaccgugggugucauucaaucaaaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaggacauuguuggcauaaaggaauggucgggguacagcggauccuucgugcaacacccugagcugacuggucuggauuguauccgaccaugcuucugggucgaacucauuagaggcaggcccgaggagaacacaaucuggaccucagggaguucuauuagcuuuuguggaguaaauuccgacacugugggcuggucauggccggauggugcagaauuaccuuucacaaucgacaaauga

SEQ ID NO: 147771 - RNA, 1410 nt, Artificial Sequence; identical to SEQ ID NO: 147770
  derived and/or modified sequence opt3 from neuraminidase__InfluenzaA__AIM56262

SEQ ID NO: 147772 - RNA, 1410 nt, Artificial Sequence; identical to SEQ ID NO: 147741
  derived and/or modified sequence opt3 from neuraminidase__InfluenzaA__AIM56273

SEQ ID NO: 147773 - RNA, 1410 nt, Artificial Sequence
  derived and/or modified sequence opt3 from neuraminidase__InfluenzaA__AIM56284
augaaccccaaucagaagaucauuaccauaggcagcgugugcaucacaauugggauggccaaccugauccuccaaauuggaaauaucauauccaucugggucucucacucaauucagaucgguaaccagagucagauugagacuuguaaucaaagcguuaucacguacgaaaacaauaccugggugaaccagacauauguaaauauauccaacacuaauuucgcugcaggccagucuguggucucggugaaacuugccgggaacucaagccugugcccuguuaguggaugggcgauuuacuccaaggacaauucugugagaaucggcagcaaaggugaugucuuugugauuagggagccauucaucuccuguucaccguuggaaugccggaccuuuuucuuaacacagggggcucugcuaaacgacaagcauaguaauggaaccaucaaagaucgcagccccuaucgaacucucaugucuuguccuauuggcgagguaccaucccccuacaacucacguuuugaaagcguugccuggagugcaucugccugccacgacggcauaaacuggcugacaaucgggauuuccggaccugauagcggugcuguggcaguccuuaaguauaauggcaucauaaccgacacgauuaagucguggagaaacaauauccugaggacucaagagucugagugugccugcgugaacggguccuguuucaccaucaugacagauggaccaucagacggccaggcuaguuacaaaauuuuucggaucgaaaaggguaaaauugucaagagcguggagaugaaugcccccaacuaucauuacgaagagugcuccuguuacccugauucuagcgagauaacuugcguuugccgcgacaauuggcacgggucaaacagaccaugggugaguuucaaucagaacuuggaauaucagaucggauacauuuguuccggcguauuuggcgauaauccgaggcccaacgacaaaaccgggagcugcggaccugugucuucaaauggugcgaacggcgucaagggguucaguuuuaaguauggaaauggcguguggaucggucggacaaaaagcaucuccucucgcaagggguucgagaugauuugggauccaaacggcuggaccggaacggacaacaaauuuucgauaaagcaagacguugugggcaucaaugaauggagcggguacuccggaucauucguccagcaucccgagcucacuggucuggauuguauucgaccuugcuucuggguggaacugaucagaggcaggccagaggagaacacaauuuggaccagugggucuagcaucuccuuuuguggaguaaauucagacacuguuggcuggagcuggcccgauggugcagaacucccguucacaauagacaaauga

SEQ ID NO: 147774 - RNA, 1410 nt, Artificial Sequence; identical to SEQ ID NO: 147741
  derived and/or modified sequence opt3 from neuraminidase__InfluenzaA__AIM56295

SEQ ID NO: 147775 - RNA, 1410 nt, Artificial Sequence; identical to SEQ ID NO: 147741
  derived and/or modified sequence opt3 from neuraminidase__InfluenzaA__AIM56306

SEQ ID NO: 147776 - RNA, 1410 nt, Artificial Sequence; identical to SEQ ID NO: 147741
  derived and/or modified sequence opt3 from neuraminidase__InfluenzaA__AIM56317

SEQ ID NO: 147777 - RNA, 1410 nt, Artificial Sequence; identical to SEQ ID NO: 147760
  derived and/or modified sequence opt3 from neuraminidase__InfluenzaA__AIM56339

SEQ ID NO: 147778 - RNA, 1410 nt, Artificial Sequence
  derived and/or modified sequence opt3 from neuraminidase__InfluenzaA__AIM56350
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaucgaacucugaugagcuguccaaucggcgagguacccucuccuuacaacucccguuuugaaucaguugccuggagcgcaagugccugccacgacggcaucaacuggcuuacaauugggauaucuggaccagauuccggugcuguggcaguccugaaguauaauggcaucauuaccgacacgaucaagagcuggagaaacaauauauugaggacucaagagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucauuacgaagagugcagcuguuacccagauuccucugagaucacuugcguuugccgcgacaauuggcacgggagcaacagaccgugggugucauucaaucagaaccucgaauaucagauuggauacauauguaguggcguauuuggcgauaaucccaggccuaacgacaaaaccggguccugcggaccagugagcucuaauggugcgaacggcgucaagggguucucauuuaaguauggaaauggcguguggaucggucggacaaaaaguauuagcucccgcaagggguucgagaugaucugggaucccaacggcuggaccggaacggacaacaauuuuucuaucaaacaagacauuguuggcauaaaggaauggucgggguacagcggauccuucgugcagcauccugagcugacuggucuggauuguauccgaccaugcuucugggucgaacucauuagaggcaggcccgaggagaacacaaucuggaccucagggaguucuauuagcuuuuguggaaucaauuccgacacugugggcuggucauggccggauggugcagaauuaccuuucacaauagacaaauga

SEQ ID NO: 147779 - RNA, 1410 nt, Artificial Sequence; identical to SEQ ID NO: 147770
  derived and/or modified sequence opt3 from neuraminidase__InfluenzaA__AIM56361

SEQ ID NO: 147780 - RNA, 1410 nt, Artificial Sequence; identical to SEQ ID NO: 147741
  derived and/or modified sequence opt3 from neuraminidase__InfluenzaA__AIM56372

SEQ ID NO: 147781 - RNA, 1410 nt, Artificial Sequence; identical to SEQ ID NO: 147770
  derived and/or modified sequence opt3 from neuraminidase__InfluenzaA__AIM56383

SEQ ID NO: 147782 - RNA, 1410 nt, Artificial Sequence
  derived and/or modified sequence opt3 from neuraminidase__InfluenzaA__AIM56394
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagauuacuugcguuugccgcgacaauuggcacgggucaaacagaccaugggugaguuucaaucagaacuuggaauaucagauaggauacaucuguuccggcauuuuuggcgauaauccgaggcccaacgacaaaaccgggagcugcggaccuguaucuucaaauggugcgaacggcgugaagggguucaguuuuaaguauggaaauggcgucuggaucggucggacaaaaagcaucuccucucgcaagggguucgagaugauuugggauccaaacggcuggaccggaacggacaacaaauuuucgauaaagcaagacaucgugggcauuaaugaauggagcggguacuccggaucauucguucagcaucccgagcucacuggucuggauuguauccgaccuugcuucuggguggaacugauuagaggcaggccagaggagaacacaaucuggaccagugggucuagcauauccuuuuguggagucaauucagacacugugggcuggagcuggcccgauggugcagaacucccguucacaaucgacaaauga

SEQ ID NO: 147783 - RNA, 1410 nt, Artificial Sequence; identical to SEQ ID NO: 147759
  derived and/or modified sequence opt3 from neuraminidase__InfluenzaA__AIM56405

SEQ ID NO: 147784 - RNA, 1410 nt, Artificial Sequence
  derived and/or modified sequence opt3 from neuraminidase__InfluenzaA__AIM56416
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacaucaauuucgcugcaggccagucuguggucccugugaaacuggccgggaacucgucauugugcccaguuagcggaugggcgauauacaguaaggacaauuccgugagaauuggcucuaaaggugaugucuuugugaucagggagccguucauuagcuguucccccuuagaaugccggaccuuuuuccugacucagggggcucuacucaacgacaagcacucaaauggaacaaucaaagaucgcaguccuuaucgaacccugaugagcuguccaaucggcgagguacccucuccuuacaacucccguuuugaaucaguugccuggagcgcaagugccugccaugacggcauuaacuggcuuacuauagggaucucuggaccagauaauggugcuguggcaguccugaaguauaacggcauuaucacagacaccauaaaguccuggagaaauaacauuuugaggacgcaggagagcgagugugccugcgugaaugggucguguuucacuaucaugaccgauggacccucugacggccaggcuuccuacaaaaucuuucggauugaaaaggguaaaaucgugaagucagucgagaugaacgccccuaauuaucacuacgaagagugcaguuguuacccagauagcuccgagauuacaugcguuugccgcgacaacuggcaugggucuaauagaccgugggugagcuucaaccaaaaucucgaauaucagauaggauacaucuguucaggcguauuuggcgauaaccccaggccuaaugacaaaacugggaguugcggaccagugaccuccaacggugcgaauggcgucaagggguucagcuuuaaguauggaaacggcguguggauuggucggacaaaaucuaucucaagucgcaagggguucgagaugaucugggaucccaacggcuggaccggaacggacaauaacuuuagcauuaaacaggacauaguuggcaucaaggaaugguccggguacucuggaucguucgugcaacacccugagcugacuggucuggauuguauucgaccaugcuucugggucgaacucaucagaggcaggcccgaggagaauacaauuuggaccagcggguccucaaucaguuuuuguggagugaacucugacacuguaggcuggagcuggccggauggugcagaauuaccuuucacaauagacaaauga

SEQ ID NO: 147785 - RNA, 1410 nt, Artificial Sequence; identical to SEQ ID NO: 147759
  derived and/or modified sequence opt3 from neuraminidase__InfluenzaA__AIM56428

SEQ ID NO: 147786 - RNA, 1410 nt, Artificial Sequence; identical to SEQ ID NO: 147741
  derived and/or modified sequence opt3 from neuraminidase__InfluenzaA__AIM56439

SEQ ID NO: 147787 - RNA, 1410 nt, Artificial Sequence
  derived and/or modified sequence opt3 from neuraminidase__InfluenzaA__AIM56450
augaaccccaaucagaagaucauuaccauaggcagcgugugcaugacaaucgggauggccaaccugauucuccaaaucggaaauauuaucuccauauggaucucucacucaauucaggucgguaaccagagucagaucgagacuuguaaucaaagcguuauuacguacgaaaacaauaccugggugaaccagacauauguaaauaucuccaacacuaauuucgcugcaggccagccuguggucucugugaaacuugccgggaacucgucacugugcccaguuagcggaugggcgauauacaguaaggacaauuccgugagagucggcucuaaaggugauguguuuguaauuagggagccguucaucagcuguucccccuuggaaugccggaccuuuuucuuaacacagggggcucugcuaaacgacaagcauucaaauggaaccauuaaagaucgcaguccuuaucgaacucucaugagcuguccaaucggcgagguucccucuccuuacaacucccguuuugaaucaguggccuggagcgcaagugccugccacgacggcaucaacuggcugacaauugggauaucuggaccagauuccggugcugucgcagugcuuaaguauaauggcaucauuaccgacacgaucaagagcuggagaaacgauauacugaggacucaagagucggagugugccugcgugaaugggucuuguuucaccauuaugacagacggacccuccgauggccaggcuucauacaaaaucuuucggaucgaaaaggguaaaauugucaagaguguugagaugaacgccccuaauuaucauuacgaagagugcagcuguuacccagacuccucugagaucacuugcgugugccgcgauaacuggcacgggagcaauagaccguggguaucauucaaccagaauuuggaauauaaaauuggauacauauguaguggcaucuuuggcgacaaccccaggccuaaugauaagaccggguccugcggaccagugagcucuaacggugcgaauggcgucaagggguucucauuuaaauauggaaacggcguguggauuggucggacaaagaguaucagcucccgcaaaggguucgagaugaucugggaccccaauggcuggaccggaacggacaacaacuuuucuguuaagcaggauauugugggcauaaaugaauggucgggguacagcggauccuucguccaacauccugagcucacuggucuggacuguauccgaccaugcuucuggguggaacugauuagaggcaggcccaaagagaacacaaucuggaccucagggaguucuauuagcuuuuguggaguaaauuccgauacuguuggcuggucauggccggacggugcagagcucccuuucacaaucgauaaguga

SEQ ID NO: 147788 - RNA, 1410 nt, Artificial Sequence
  derived and/or modified sequence opt3 from neuraminidase__InfluenzaA__AIM56461
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggaaaaacaauauucugagaacucaagagucugagugugccugcgugaacggguccuguuucaccaucaugacagauggaccaucagacggccaggcuaguuacaagaucuuuaggauugaaaaagguaagaucgugaaaagcgucgagaugaaugcccccaacuaucauuacgaagagugcuccuguuacccugauucuagcgagauuacuugcguuugccgggacaauuggcacgggucaaaccgcccaugggugaguuucaaucagaacuuggaauaucagauaggauacaucuguuccggcguauuuggcgauaauccgagacccaacgacaagaccgggagcugcggaccugugucuucaaauggugcgaacggcgucaagggguucaguuuuaaauauggaaauggcguguggauugguaggacaaagagcaucuccucucggaaaggguucgagaugaucugggauccaaacggcuggaccggaacggacaacaaguuuucgauuaaacaagacauaguuggcgugaaugaauggagcggguacuccggaucauucguccagcaucccgagcucacuggucuggauuguauccgcccuugcuucuggguggaacugauucgaggcagaccagaggagaacacaaucuggaccagugggucuagcauuuccuuuuguggaguaaauucagacacuguuggcuggagcuggcccgauggugcagaacucccguucacaaucgacaaguga

SEQ ID NO: 147789 - RNA, 1410 nt, Artificial Sequence
  derived and/or modified sequence opt3 from neuraminidase__InfluenzaA__AIM56472
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugcaacgacggcauuaauuggcugacaauagggaucuccggaccugauagcggugcuguggcaguccuuaaguauaacggcauuaucaccgacacgauaaagucguggagaaauaacauucugaggacucaagagucugagugugccugcgugaauggguccuguuucaccaucaugacagauggaccaucagacggccaggcuaguuacaaaaucuuucggauugaaaaggguaaaaucgucaagagcguggagaugaacgcccccaauuaucacuacgaagagugcuccuguuacccugauucuagcgagauuacuugcguuugccgcgacaacuggcaugggucaaauagaccaugggugaguuucaaccagaauuuggaauaucagauaggauacaucuguuccggcguauuuggcgauaacccgaggcccaaugacaaaaccgggagcugcggaccugugucuucaaacggugcgaauggcgucaagggguucaguuuuaaguauggaaacggcguguggauuggucggacaaaaagcaucuccucucgcaagggguucgagaugaucugggauccaaacggcuggaccggaacggacaauaaauuuucgauuaagcaagacauaguuggcaucaacgaauggagcggguacuccggaucauucgugcagcaccccgagcucacuggucuggauuguauucgaccuugcuucugggucgaacugaucagaggcaggccagaggagaauacaauuuggaccagugggucuagcaucuccuuuuguggagugaacucagacacuguaggcuggagcuggcccgauggugcagaacucccguucacaauagacaaauga

SEQ ID NO: 147790 - RNA, 1410 nt, Artificial Sequence; identical to SEQ ID NO: 147747
  derived and/or modified sequence opt3 from neuraminidase__InfluenzaA__AIM56483

SEQ ID NO: 147791 - RNA, 1410 nt, Artificial Sequence; identical to SEQ ID NO: 147770
  derived and/or modified sequence opt3 from neuraminidase__InfluenzaA__AIM56494

SEQ ID NO: 147792 - RNA, 1410 nt, Artificial Sequence; identical to SEQ ID NO: 147760
  derived and/or modified sequence opt3 from neuraminidase__InfluenzaA__AIM56505

SEQ ID NO: 147793 - RNA, 1410 nt, Artificial Sequence; identical to SEQ ID NO: 147759
  derived and/or modified sequence opt3 from neuraminidase__InfluenzaA__AIM56516

SEQ ID NO: 147794 - RNA, 1410 nt, Artificial Sequence
  derived and/or modified sequence opt3 from neuraminidase__InfluenzaA__AIM56527
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcagagcagucuguggucucggugaaacuggccggcaacagcagcuugugcccuguuagugggugggcgaucuacuccaaggacaauucugugagaauaggaagcaaaggcgaugucuuugugauuagggaaccauucaucuccuguucaccguuagagugccggaccuuuuuccugacacagggugcucuacucaacgacaagcauaguaaugggaccauuaaagaucgcagccccuaucgaacucugaugucuuguccuaucggagaaguaccaucccccuacaacucacguuuugagagcguugccuggagugcaucugccugccacgacggcaucaacuggcuuacaauuggcauauccgggccugauagcggagcuguggcaguccugaaguauaaugguaucauuaccgacacgaucaagucguggagaaacaauauauugaggacucaagagucugaaugugccugcgugaacggcuccuguuucaccauuaugacagaugggccaucagacggacaggcuaguuacaaaaucuuucggaucgagaagggcaaaauugugaagucagucgaaaugaaugcccccaacuaucauuacgaggagugcuccuguuacccugauucuagcgaaaucacuugcguuugccgcgacaauuggcacgguucaaacagaccaugggugaguuucaaucagaaccucgaguaucagauuggguacauauguuccggaguacugggcgauaauccgaggcccaacgacaaaaccggcagcugcgggccugugucuucaaauggagcgaacggugucaagggcuuuaguuucaaguaugggaauggaguguggaucggccggacaaaaagcauuuccucucgcaaggguuuugaaaugguuugggauccaaacggguggaccggcacggacaacaauuucucgaucaaacaagacaucgugggaauuaaggaguggagcggcuacuccgggucauuuguccagcaucccgaacugacuggacucgauuguauacgaccuugcuucuggguggaguuaaucagagguaggccagaggaaaacacaauuuggaccaguggcucuagcaucuccuucugugggguaaauucagacacuguuggauggagcuggcccgauggcgcagagcugccguuuacaauugacaaauga

SEQ ID NO: 147795 - RNA, 1410 nt, Artificial Sequence; identical to SEQ ID NO: 147741
  derived and/or modified sequence opt3 from neuraminidase__InfluenzaA__AIM56538

SEQ ID NO: 147796 - RNA, 1410 nt, Artificial Sequence
  derived and/or modified sequence opt3 from neuraminidase__InfluenzaA__AIM56549
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagguuacuugcgugugccgcgacaauuggcacgggucaaacagaccauggguaaguuucaaucagaacuuggaauaucagauuggauacauauguuccggcguguuuggcgauaauccgaggcccaacgacaaaaccgggagcugcggaccugucucuucaaauggugcgaacggcgugaagggguucaguuuuaaguauggaaauggcguuuggaucggucggacaaaaagcauuuccucucgcaagggguucgagaugaucugggauccaaacggcuggaccggaacggacaacaaauuuucgaucaagcaagacauugugggcauaaaugaauggagcggguacuccggaucauucguccagcaucccgagcucacuggucuggauuguauccgaccuugcuucuggguggaacugauuagaggcaggccagaggagaacacaaucuggaccagugggucuagcauuuccuuuuguggaguaaauucagacacuguuggcuggagcuggcccgauggugcagaacucccguucacaaucgacaaauga

SEQ ID NO: 147797 - RNA, 1410 nt, Artificial Sequence
  derived and/or modified sequence opt3 from neuraminidase__InfluenzaA__AIM56560
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacacuaauuucgcugcaggccagucuguggucccugugaaacuggccgggaacucgucauugugcccaguuagcggaugggcgauccacaguaaggacaauuccgugagaauaggcucuaaaggugaugucuuugugauuagggagccguucaucagcuguucccccuuagaaugccggaccuuuuuccugacacagggggcucuacucaacgacaagcauucaaauggaaccauuaaagaucgcaguccuuaccgaacucugaugagcuguccaaucggcgagguacccucuccuuauaacucccguuuugaaucaguugccuggagcgcaagugccugccacgacggcaucaacuggcuuacaauugggauaucuggaccagauaauggugcuguggcaguccugaaguacaacggcaucauuaccgacacgaucaaguccuggagaaauaacauauugaggacucaggagagcgagugugccugcgugaaugggucguguuucaccauuaugacagauggacccucugacggccaggcuuccuauaaaaucuuucggaucgaaaaggguaaaauugugaagucagucgagaugaacgccccuaauuaccauuaugaagagugcaguuguuacccagauagcuccgagaucacuugcguuugccgcgacaacuggcacgggucuaauagaccgugggugagcuucaaccaaaaucucgaauaccagauuggauauauauguucaggcguauuuggcgauaaccccaggccuaaugacaaaaccgggaguugcggaccagugacauccaacggugcgaauggcgucaagggguucagcuuuaaguacggaaacggcguguggaucggucggaccaaaucuauuucaagucgcaagggguucgagaugaucugggaucccaacggcuggacgggaacugacaauaacuuuagcaucaaacaggacauuguuggcauaaaggaaugguccggguauucuggaucguucgugcaacacccugagcugacaggucuggauuguauccgaccaugcuucugggucgaacucauuagaggcaggcccgaggagaauaccaucuggacuagcggguccucaauuaguuuuuguggagugaacucugacacaguaggcuggagcuggccggauggugcagaauuaccuuucaccaucgacaaauga

SEQ ID NO: 147798 - RNA, 1410 nt, Artificial Sequence; identical to SEQ ID NO: 147747
  derived and/or modified sequence opt3 from neuraminidase__InfluenzaA__AIM56571

SEQ ID NO: 147799 - RNA, 1410 nt, Artificial Sequence
  derived and/or modified sequence opt3 from neuraminidase__InfluenzaA__AIM56582
augaaccccaaucagaagaucauuaccauaggcagcgugugcaucacaauugggauggccaaccugauccuccaaauuggaaauaucauauccaucugggucucucacucaauucagcuugguaaccagagucagaucgagacuuguaaucaaagcguuauuacguacgaaaacaauaccugggugaaccagacauauguaaauaucuccaacacuaauuucgcugcaggccagucuguggucucggugaaacuggccgggaacucaucauugugcccuguuaguggaugggcgauauacuccaaggacaauucugugagaauuggcagcaaaggugaugucuuugugaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgagguaccaucccccuacaacucacguuuugaaagcguugccuggagugcaucugccugccacgacggcauuaacuggcuuacaauagggaucuccggaccugauagcggugcuguggcaguccugaaguauaauggcauuaucaccgacacgauaaagucguggagaaacaauauuuugaggacucaagagucugagugugccugcgugaacggguccuguuucaccaucaugacagauggaccaucagacggccaggcuaguuacaaaaucuuucggauugaaaaggguaaaaucgucaagagcguggagaugaaugcccccaacuaucauuacgaagagugcuccuguuacccugauucuagcgagauuacuugcguuugccgcgacaauuggcacgggucaaacagaccaugggugaguuucaaucagaaccucgaauaucagauaggauacaucuguuccggcguauuuggcgauaauccgaggcccaacgacaaaaccgggagcugcggaccugugucuucaaauggugcgaacggcgucaagggguucaguuuuaaguauggaaauggcguguggauuggucggacaaaaagcaucuccucucgcaagggguucgagaugaucugggauccaaacggcuggaccggaacggacaacaauuuuucgauuaaacaagacauaguuggcaucaaggaauggagcggguacuccggaucauucgugcagcaucccgagcugacuggucuggauuguauucgaccuugcuucugggucgaacucaucagaggcaggccagaggagaacacaauuuggaccagugggucuagcaucuccuuuuguggagugaauagcgacacuguaggcuggagcuggcccgauggugcagaauuaccguucacaauagacaaauga

SEQ ID NO: 147800 - RNA, 1410 nt, Artificial Sequence
  derived and/or modified sequence opt3 from neuraminidase__InfluenzaA__AIM56593
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcagagcagucuguggucucggugaaacuggccggcaacucaucauugugcccuguuagugggugggcgaucuacuccaaggacaauucugugagaauaggaagcaaaggcgaugucuuugugauuagggaaccauucaucuccuguucaccguuagagugccggaccuuuuuccugacacagggugcucuacucaacgacaagcauaguaaugggaccauuaaagaucgcagccccuaucgaacucugaugucuuguccuaucggagaaguaccaucccccuacaacucacguuuugagagcguugccuggagugcaucugccugccacgacggcaucaacuggcuuacaauuggcauauccgggccugauagcggagcuguggcaguccugaaguauaaugguaucauuaccgacacgaucaagucguggagaaacaauauauugaggacucaagagucugaaugugccugcgugaacggcuccuguuucaccauuaugacagaugggccaucagacggacaggcuaguuacaaaaucuuucggaucgagaagggcaaaauugucaagagcguggaaaugaaugcccccaacuaucauuacgaggagugcuccuguuacccugauucuagcgaaaucacuugcguuugccgcgacaauuggcacgguucaaacagaccaugggugaguuucaaucagaaccucgaguaucagauuggguacauauguuccggaguacugggcgauaauccgaggcccaacgacaaaaccggcagcugcgggccugugucuucaaauggagcgaacggugucaagggcuuuaguuucaaguaugggaauggaguguggaucggccggacaaaaagcauuuccucucgcaaggguuuugaaaugaucugggauccaaacggguggaccgagacggacaacaauuucucgaucaaacaagacauuguuggcauaaaggaauggagcggauacuccggcucauuugugcagcaucccgagcugacugggcucgauuguauccgaccuugcuucugggucgaguuaauuagaggaaggccagaagagaacacaaucuggaccagugguucuagcauuuccuucuguggcgugaauagcgacacuguaggguggagcuggcccgauggagcagaacugccguuuacaaucgacaaauga

SEQ ID NO: 147801 - RNA, 1410 nt, Artificial Sequence
  derived and/or modified sequence opt3 from neuraminidase__InfluenzaA__AIM56604
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacauaaauuucgcugcaggccagucuguggucucggugaaacuugccgggaacucaagccugugcccuguuaguggaugggcgauuuacuccaaggacaauucugugagaaucggcagcaaaggugaugucuuugugauuagggagccauucaucuccuguucaccguuggaaugccggaccuuuuucuuaacucagggggcucugcuaaacgacaagcauaguaauggaacaaucaaagaucgcagccccuaucgaacccucaugucuuguccuauuggcgagguaccaucccccuacaacucacguuuugaaagcguugccuggagugcaucugccugccacgacggcauaaacuggcugacuaucgggauuuccggaccugauagcggugcuguggcaguccuuaaguauaauggcaucauaacagacaccauuaagucguggagaaacaauauccugaggacgcaagagucugagugugccugcgugaacggguccuguuucacuaucaugaccgauggaccaucagacggccaggcuaguuacaaaauuuuucggaucgaaaaggguaaaauugugaagucagucgagaugaaugcccccaacuaucauuacgaagagugcuccuguuacccugauucuagcgagauaacaugcguuugccgcgacaauuggcacgggucaaacagaccaugggugaguuucaaucagaacuuggaauaucagaucggauacauuuguuccggcguauuuggcgauaauccgaggcccaacgacaaaacugggagcugcggaccugugucuucaaauggugcgaacggcgucaagggguucaguuuuaaguauggaaauggcguguggaucggucggaccaaaagcaucuccucucgcaagggguucgagaugauuugggauccaaacggcuggacaggaaccgacaacaaauuuucgauaaagcaagacaucguuggcauuaaugaauggagcggguacuccggaucauucgugcagcaucccgagcucacgggucuggauuguauccgaccuugcuucugggucgaacugauuagaggcaggccagaggagaacacuaucuggacaagugggucuagcauauccuuuuguggagugaauagcgacaccguaggcuggagcuggcccgauggugcagaacucccguucacuaucgacaaauga

SEQ ID NO: 147802 - RNA, 1410 nt, Artificial Sequence
  derived and/or modified sequence opt3 from neuraminidase__InfluenzaA__AIM56615
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguagacaucuccaauacuaacuucgcugcaggccagucuguggucucggugaaacuugccgggaauagcagccugugcccuguuaguggaugggcgauauacuccaaggauaacucugugagaauuggcagcaaaggugacgucuuugugaucagggagccauucauuuccuguucaccguuggaaugccggaccuuuuucuuaacacagggggcucugcuaaaugauaagcauaguaacggaaccaucaaagaccgcagccccuaucgaacucucaugucuuguccuaucggcgagguaccaucccccuacaauucacguuuugaaagcguugccuggagugcaucugccugccacgauggcauuaacuggcugacaauagggaucuccggaccugacagcggugcuguggcaguccuuaaguauaacggcauuaucaccgauacgauaaagucguggagaaauaacauucugaggacucaagagucugagugugccugcgugaauggguccuguuucaccaucaugacagacggaccaucagauggccaggcuaguuacaaaaucuuucggauugaaaaggguaaaaucgugaagucagucgagaugaacgcccccaauuaucauuacgaagagugcuccuguuacccugacucuagcgagauuacuugcguuugccgcgauaacuggcacgggucaaauagaccaugggugaguuucaaccagaauuuggaauaucagauaggauacaucuguuccggcguauuuggcgacaacccgaggcccaaugauaaaaccgggagcugcggaccugugucuucaaacggugcgaauggcgucaagggguucaguuuuaaguauagcaacggaguguggauuggccggacaaaauccaucucuucgcgcaaggguuucgagaugaucugggacccaaauggguggaccggcacggacaacaaauuuagcauuaagcaagauauaguuggaaucaacgaaugguccggcuacucagggaguuucgugcagcaucccgagcucacuggacuggacuguauucgaccuugcuucugggucgaacugaucagagguaggccagaggagaauacaauuuggaccucuggcagcuccaucucauuuuguggggugaacagcgauacuguaggauggucuuggcccgacggcgcagaacucccguucacaauagauaaauga

SEQ ID NO: 147803 - RNA, 1410 nt, Artificial Sequence; identical to SEQ ID NO: 147796
  derived and/or modified sequence opt3 from neuraminidase__InfluenzaA__AIM56626

SEQ ID NO: 147804 - RNA, 1410 nt, Artificial Sequence; identical to SEQ ID NO: 147741
  derived and/or modified sequence opt3 from neuraminidase__InfluenzaA__AIM56637

SEQ ID NO: 147805 - RNA, 1410 nt, Artificial Sequence; identical to SEQ ID NO: 147747
  derived and/or modified sequence opt3 from neuraminidase__InfluenzaA__AIM56648

SEQ ID NO: 147806 - RNA, 1410 nt, Artificial Sequence
  derived and/or modified sequence opt3 from neuraminidase__InfluenzaA__AIM56659
augaaccccaaucagaagaucauuaccauaggcagcgugugcaugacaaucgggauggccaaccugauucuccaaaucggaaauauuaucuccauaugggucucucacucaauccagcuugguaaccagagucauauugagacuuguaaucagagcguuaucacguacgaaaacaauaccugggugaaccaaacauauguaaauauuuccaacacuaauuucgcugcaggccagucuguggucccugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccugacacagggggcucuacucaacgacaagcacucaaauggaaccauuaaagaucgcaguccuuaucgaacucugaugagcuguccaaucggcgagguacccucuccuuacaacucccguuuugaaucaguugccuggagcgcaagugccugccaugacggcaucaacuggcuuacaauugggauaucuggaccagauuccggugcuguggcaguccugaaguauaauggcaucauuaccgacacgaucaagagcuggagaaacaauauauugaggacucaggagucggagugugccugcgugaacgggucuuguuucaccauuaugacagauggacccuccgacggccaggcuucauacaaaaucuuucggaucgaaaaggguaaaauugugaagagugucgagaugaaugccccuaacuaucacuacgaagagugcagcuguuacccagauuccucugagaucacuugcguuugccgcgacaauuggcaugggagcaacagaccgugggugucauucaaucaaaaccucgaauaucagauuggauacauauguaguggcguauuuggcgauaaucccaggccuaacgacaaaaucggguccugcggaccagugagcucuaauggugcgaacggcgucaagggguucucauuuaaguauggaaauggcguguggauuggucggaccaaaaguaucagcucccgcaagggguucgagaugaucugggaucccaacggcuggacaggaaccgacaacaauuuuucuauuaaacaggacauaguuggcaucaaggaauggucgggguacagcggauccuucgugcaacacccugagcugacgggucuggauuguauucgaccaugcuucugggucgaacucaucagaggcaggcccgaggagaaaacuauuuggacaucagggaguucuaucagcuuuuguggagugaacuccgacaccguaggcuggucauggccggauggugcagaauuaccuuucacuauagacaaguga

SEQ ID NO: 147807 - RNA, 1410 nt, Artificial Sequence
  derived and/or modified sequence opt3 from neuraminidase__InfluenzaA__AIM56670
augaaccccaaucagaagaucauuaccauaggcagcgugugcaugacaaucgggauggccaaccugauucuccaaaucggaaauacuauuuccaucugggucucucacucaauacagaucgguaaccagagucagauugagacguguaaucaaagcguuaucaccuacgaaaacaauacaugggugaaccagacuuauguaaauauuuccaacaccaauuucgcugcaggccagucuguggucucggugaaacuugccgggaacucaagccugugcccuguuaguggaugggcgaucuacuccaaggacaauucugugagaauaggcagcaaaggugaugucuuugugauuagggagccauucaucuccuguucaccguuggaaugccggacauuuuucuuaacccagggggcucugcuaaacgacaagcauaguaauggaacuauuaaagaucgcagccccuaucgaacacucaugucuuguccuaucggcgagguaccaucccccuacaacucacguuuugaaagcguugccuggagugcaucugccugccacgacggcaucaacuggcugaccauugggauauccggaccugauagcggugcuguggcaguccuuaaguauaauggcaucauuacggacacuaucaagucguggagaaacaauauacugaggacccaagagucugagugugccugcgugaacggguccuguuucacaauuaugacugauggaccaucagacggccaggcuaguuacaaaaucuuucggaucgaaaaggguaaaauugugaagucagucgagaugaaugcccccaacuaucauuacgaagagugcuccuguuacccugauucuagcgagaucacuugcguuugccgcgacaauuggcacgggucaaacagaccaugggugaguuucaaucagaacuuggaauaucagauuggauacauauguuccggcguauuuggcgauaauccgaggcccaacgacaaaacagggagcugcggaccugugucuucaaauggugcgaacggcgucaagggguucaguuuuaaguauggaaauggcguguggaucggucggaccaaaagcauuuccucucgcaagggguucgagaugaucugggauccaaacggcuggacgggaacugacaacaaauuuucgaucaagcaagacauuguuggcauaaaugaauggagcggguacuccggaucauucgugcagcaucccgagcucacaggucuggauuguauccgaccuugcuucugggucgaacugauuagaggcaggccagaggagaacaccaucuggaccagugggucuagcauuuccuuuuguggagugaauagcgacacaguaggcuggagcuggcccgauggugcagaacucccguucaccaucgacaaauga

SEQ ID NO: 147808 - RNA, 1410 nt, Artificial Sequence; identical to SEQ ID NO: 147759
  derived and/or modified sequence opt3 from neuraminidase__InfluenzaA__AIM56703

SEQ ID NO: 147809 - RNA, 1410 nt, Artificial Sequence
  derived and/or modified sequence opt3 from neuraminidase__InfluenzaA__AIM56714
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgugaaguccgucgagaugaaugcccccaacuaucauuacgaagagugcuccuguuacccugauucuagcgagauuacuugcguuugccgcgacaauuggcacgggucaaacagaccaugggugaguuucaaucagaacuuggaauaucagauaggauacaucuguuccggcguauuuggcgauaauccgaggcccaacgacaaaaccgggagcugcggaccugugccaucuaauggugcgaacggcgucaagggguucucauuuaaguauggaaauggcguguggauuggucggacaaaaaguaucagcucccgcaagggguucgagaugaucugggaucccaacggcuggaccggaacggacaacaaauuuucuauuaagcaagacauaguuggcaucaaugaauggucgggguacagcggauccuucgugcagcauccugagcucacuggucuggauuguauucgaccaugcuucugggucgaacugaucagaggcaggcccgaggagaacacaauuuggaccucagggaguucuaucagcuuuuguggagugaauagcgacacuguaggcuggucauggccggauggugcagaacucccuuucacaauagacaaauga

SEQ ID NO: 147810 - RNA, 1410 nt, Artificial Sequence
  derived and/or modified sequence opt3 from neuraminidase__InfluenzaA__AIM56725
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgugaagucagucgagaugaaugcccccaacuaucauuacgaagagugcuccuguuacccugauucuagcgagguuacuugcgugugccgcgacaauuggcacgggucaaacagaccauggguaaguuucaaucagaacuuggaauaucagauuggauacauauguuccggcaucuuuggcgauaauccgaggcccaacgacaaaaccgggagcugcggaccugugucuucaaauggugcgaacggcgucaagggguucaguuuuaaguauggaaauggcguguggauuggucggacaaaaagcaucuccucucgcaagggguucgagaugaucugggauccaaacggcuggaccggaacggacaacaaauuuucgauuaagcaagacauaguuggcaucaaugaauggagcggguacuccggaucauucgugcagcaucccgagcucacuggucuggauuguauucgaccuugcuucugggucgaacugaucagaggcaggccagaggagaacacaauuuggaccagugggucuagcaucuccuuuuguggagugaauagcgacacuguaggcuggagcuggcccgauggugcagaacucccguucacaauagacaaauga

SEQ ID NO: 147811 - RNA, 1410 nt, Artificial Sequence; identical to SEQ ID NO: 147759
  derived and/or modified sequence opt3 from neuraminidase__InfluenzaA__AIM56736

SEQ ID NO: 147812 - RNA, 1410 nt, Artificial Sequence
  derived and/or modified sequence opt3 from neuraminidase__InfluenzaA__AIM56747
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaaguuuggaaugccggaccuuuuucuuaacacagggggcucugcuaaacgacaagcauagcaauggaaccaucaaagaucgcucuccguaucgaacucucauguccugucccaucggcgagguaccuucaccauacaacagccguuuugaaaguguugccuggucugcauccgccugccacgacggcauuaacuggcugacaauagggaucagcggacccgauucgggugcuguggcaguccuuaaguauaauggcauuaucaccgacacgauaaagucuuggagaaacaauauucugaggacucaagaguccgagugugccugcgugaacgggucauguuucaccaucaugacagauggaccuagugacggccaggcuagcuacaaaaucuuucggauugaaaaggguaaaaucgugaaguccgucgagaugaaugccccaaacuaucauuacgaagagugcucuuguuaccccgauagcucagagauuacuugcguuugccgcgacaauuggcacgggaguaacagaccuuggguguccuucaaucagaacuuggaauaucagauaggauacaucuguagcggcguauuuggcgauaauccaaggccgaacgacaaaaccgggucuugcggacccgugucaaguaauggugcgaacggcgucaagggguucagcuuuaaguauggaaauggcguguggauuggucggacaaaauccaucucuucgcgcaagggguucgagaugaucugggauccuaacggcuggaccggaacggacaacaaauuuagcauuaagcaagacauaguuggcaucaaugaaugguccggguacucaggaaguuucgugcagcauccagagcucacuggucuggauuguauucgacccugcuucugggucgaacugaucagaggcaggccugaggagaacacaauuuggaccucugggagcuccaucucauuuuguggagugaauagcgacacuguaggcuggucuuggccagauggugcagaacuccccuucacaauagacaaauga

SEQ ID NO: 147813 - RNA, 1410 nt, Artificial Sequence; identical to SEQ ID NO: 147796
  derived and/or modified sequence opt3 from neuraminidase__InfluenzaA__AIM56758

SEQ ID NO: 147814 - RNA, 1410 nt, Artificial Sequence; identical to SEQ ID NO: 147759
  derived and/or modified sequence opt3 from neuraminidase__InfluenzaA__AIM56769

SEQ ID NO: 147815 - RNA, 1410 nt, Artificial Sequence
  derived and/or modified sequence opt3 from neuraminidase__InfluenzaA__AIM56780
augaaccccaaucagaagaucauuaccauaggcagcgugugcaugacaaucgggauggccaaccugauucuccaaaucggaaauauuaucuccauaugggucucucacucaauccagcuugguaaccagagucagauuggcacuuguaaucaaagcguuaucacguacgagaacaauaccugggugaaccagacauauguaaauauuuccaacacuaauuucgcugcagggcagucuguggucucggugaaacuggccggaaacagcucauugugcccuguuaguggcugggcgaucuacuccaaggacaauucugugagaauagguagcaaaggggaugucuuugugauuagggaaccauucaucuccuguucaccguuagagugccggaccuuuuuccugacacagggagcucuacucaacgacaagcauaguaauggcaccauuaaagaucgcagccccuaucgaacucugaugucuuguccuaucggcgaaguaccaucccccuacaacucacguuuugagagcguugccuggagugcaucugccugccacgacgggaucaacuggcuuacaauuggaauauccgguccugauagcggcgcuguggcaguccugaaguauaaugggaucauuaccgacacgaucaagucguggagaaacaauauauugaggacucaagaaucugagugugccugcgugaacggauccuguuucaccauuaugacagauggcccaucagacggucaggcuaguuacaaaaucuuucggaucgagaaggggaaaauuaucaagagcguggaaaugaaugcccccaacuaucauuacgaggaaugcuccuguuacccugauucuagcgagauuacuugcgucugccgcgacaauuggcacggaucaaacagaccauggguuaguuucaaucagaaccucgaguaucagauaggcuacaucuguuccggcguguuuggggauaauccgaggcccaacgacaaaaccggaagcugcgguccuguaucuucaaauggcgcgaacggggugaagggauucaguuuuaaguauggcaauggugucuggauugggcggacaaaaagcaucuccucucgcaagggcuucgaaaugaucugggauccaaacggauggaccggcacggacaacaaauuuucgauuaagcaagacauaguggggauccaugaguggagcggauacuccgguucauucguucagcaccccgaacugacuggccuggauuguauucgaccuugcuucuggguggagcucaucagagggaggccagaagagaauacaauuuggaccaguggaucuagcaucuccuuuuguggcgucaacucagacacuguggguuggagcuggcccgauggggcagaguuaccguucacaauagacaaauga

SEQ ID NO: 147816 - RNA, 1410 nt, Artificial Sequence
  derived and/or modified sequence opt3 from neuraminidase__InfluenzaA__AIM56791
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcucauugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuaucggcgagguaccaucccccuacaacucacguuuugaaagcguugccuggagugcaucugccugccacgacggcaucuccuggcuuacaauugggauaagcggaccugauucgggugcuguggcaguccugaaguauaacggcaucauuaccgacacgaucaagucuuggagaaauaacauauugaggacucaagaguccgagugugccugcgugaaugggucauguuucaccauuaugacagauggaccaagugacggccaggcuagcuacaaaaucuuucggaucgaaaaggguaaaauugugaaguccgucgagaugaacgcccccaauuaucauuacgaagagugcucuuguuacccugauagcucagagaucacuugcguuugccgcgacaacuggcacgggaguaauagaccauggguguccuucaaccagaaucucgaauaucagauuggauacauauguagcggcguauuuggcgauaacccgaggcccaaugacaaaaccgggucuugcggaccugugucaaguaacggugcgaauggcgucaagggguucagcuuuaaguauggaaacggcguguggaucggucggacaaaauccauuucuucgcgcaagggguucgagaugaucugggauccaaauggcuggaccggaacggacaacaacuuuagcaucaaacaagacauuguuggcauaaaggaaugguccggguacucaggaaguuucgugcagcaucccgagcugacuggucuggauuguauccgaccuugcuucugggucgaacucauuagaggcaggccagaggagaauacaaucuggaccucugggagcuccauuucauuuuguggagugaacagcgacacuguaggcuggucuuggcccgauggugcagaauuaccguucacaaucgacaaauga

SEQ ID NO: 147817 - RNA, 1410 nt, Artificial Sequence
  derived and/or modified sequence opt3 from neuraminidase__InfluenzaA__AIM56813
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucaaaguuugaaagcguugccuggagugcaucugccugccacgacggcauuaacuggcugacaauagggaucuccggaccugauaauggugcuguggcaguccuuaaguauaacggcauuaucaccgacacgauaaaaagcuggcguaauaacauucugagaacucaagagucggagugugccugcgugaaugggucuuguuucaccaucaugacagauggaccauccgacggccaggcuucauacaagaucuuuaggauugaaaaagguaagaucgugaaaagugucgagaugaacgcccccaauuaucauuacgaagagugcagcuguuacccugauuccucugagauuacuugcguuugccgggacaacuggcacgggagcaaucgcccaugggugucauucaaccagaauuuggaauaucagauaggauacaucuguaguggcguauuuggcgauaacccgagacccaaugacaagaccggguccugcggaccugugagcucuaacggugcgaauggcgucaagggguucucauuuaaauauggaaacggcguguggauugguaggacaaagaguaucagcucccggaaaggguucgagaugaucugggauccaaacggcuggaccggaacggacaauaaguuuucuauuaaacaagacauaguuggcaucaacgaauggucgggguacagcggauccuucgugcagcaucccgagcucacuggucuggauuguauucgcccuugcuucugggucgaacugauccgaggcagaccagaggagaauacaauuuggaccucagggaguucuaucagcuuuuguggagugaacuccgacacuguaggcuggucauggcccgauggugcagaacucccguucacaauagacaaguga

SEQ ID NO: 147818 - RNA, 1410 nt, Artificial Sequence
  derived and/or modified sequence opt3 from neuraminidase__InfluenzaA__AIM56824
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucgugaagucagucgagaugaaugcccccaacuaucauuacgaagagugcuccuguuacccugauucuagcgagauuacuugcguuugccgcgacaauuggcacgggucaaacagaccaugggugaguuucaaucagaacuuggaauaucagauaggauacaucuguuccggcguauuuggcgauaauccgaggcccaacgacaaaaccgggagcugcggaccugugccaucuaauggugcgaacggcgucaagggguucucauuuaaguauaguaauggaguguggauuggccggacaaaaagcaucuccucucgcaaggguuucgagaugaucugggaucccaacggguggaccggcacggacaacaaauuuucgauuaagcaagacauaguuggaaucaaugaauggagcggcuacuccgggucauucgugcagcauccugagcucacuggacuggauuguauucgaccaugcuucugggucgaacugaucagagguaggcccgaggagaacacaauuuggaccaguggcucuagcaucuccuuuuguggggugaauagcgacacuguaggauggagcuggccggauggcgcagaacucccuuucacaauagacaaauga

SEQ ID NO: 147819 - RNA, 1398 nt, Artificial Sequence
  derived and/or modified sequence opt3 from neuraminidase__InfluenzaA__AIN76385
augaaccccaaucagaagauccugugcaccagcgccacagcuauuauaaucggcgcaauugccgugcucaucgggauugcgaaccuuggacugaauaucgguuugcacuuaaaaccuggcuguaacugcucccauucucaaccagggacuacgaauaccucacagacaauaaucaacaauuacuauaacgagacuaauauuaccaacauccagauggaagagagaacaaguaggaauuucaacagccugaccaagggacuauguacuauuaauuccuggcacaucuacggcaaagacaacgcuguccggauaggugaaucuucggauguucucgugacacgcgagccguauguaucaugcgaccccgaugaaugucgauuuuacgcccugagccaggggaccacgauucguggaaagcauaguaauggcacuauccacgacagaucccaauauagggcacuuauuucuuggccucugagcuccccacccaccguguacaacucacgggucgagugcaucggcuggaguagcacaucuugucaugaugggaaaucccgcaugucaaucugcauuagcggaccuaacaauaacgccagugcugugguuugguauaauagaaggccaguggcagagauaaacacuugggcccggaauaucuugcgcacccaggaaucugagugugucugccacaacgguauuugucccaucguguucacagacggcuccgcuaccgggccugccgauacgcgaauauacuacuuuaaggaaggaaagauucucaaaugggagagccugacuggcacagcgaagcacaucgaggaaugcucgugcuauggugagagaaccgggaucacuuguacaugcaaagacaauuggcagggaucuaacaggccaguaauucagaucgauccgguugcaaugacccauacgucccaauacauuuguucacccgugcugaccgacacaccucggccaaaugaucccaacauaggcaagugcaaugacccuuauccaggcaacaauaacaauggggucaaaggauucaguuaccucgauggugccaacacuugguuaggccguaccaucagcacagcuucccgcucuggguaugaaaugcugaaggugcccaacgcccuuacugacgacagaagcaagccgauucagggacagaccaucguguugaaugcagauuggucaggcuacagugguuccuuuauggacuauugggcugagggggauuguuacagggccugcuucuacgucgaacugauccggggccgaccuaaagaggacaagguuugguggacaagcaacucuauugugucaauguguaguagcaccgaguuucuaggacaguggaauuggcccgauggcgcgcgcauagaauauuuccucuga

SEQ ID NO: 147820 - RNA, 1410 nt, Artificial Sequence; identical to SEQ ID NO: 136103
  derived and/or modified sequence opt3 from neuraminidase__InfluenzaA__AIP93105

SEQ ID NO: 147821 - RNA, 1410 nt, Artificial Sequence
  derived and/or modified sequence opt3 from neuraminidase__InfluenzaA__AIP93117
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuucuaaggaccugcgcagcgguuacgaaacuuuuaagguuauaggcggguggucaacaccuaauaguaaaucccaggugaacagacaagucaucguggauaauaacaauuggagcggauauucuggcauuuucucaguagaggguaagaguugcaucaacagguguuuuuacguugagcuuauccgggggcgaccacaggaaacccgcgugugguggacgagcaauuccauugucguguucugcggcaccucuggaacauauggcacugggucguggcccgacggagcaaacauaaauuuuaugccgaucuga

SEQ ID NO: 147822 - RNA, 1410 nt, Artificial Sequence
  derived and/or modified sequence opt3 from neuraminidase__InfluenzaA__AIR93973
augaaccccaaucagaagaucauuaccauaggcagcgugugcaugacaaucgggauggccaaccugauucuccaaaucggaaauauuaucuccauauggaucucucacucaauucagcuugguaguagaaaccagaucgaggcuuguaaucagagcgucauuacuuacgaaaacaauacguggguuaaccaaaccuaugugaauaucuccaacacaaauuucgcagccggccagucuguagugccugucaaacuggcggggaacucgucauugugcccagugagcggaugggcuauauacaguaaggacaauuccauuaggaucggcucuaaaggugauguuuuugugauucgggagccguucaucagcuguucccccuuagaaugccgcaccuuuuuccugacucagggggcccuacucaacgacaagcauucaaauggaacaaucaaagaucgaaguccuuaucguacccugaugagcuguccaauuggcgagguccccucuccuuacaacuccagauuugaaucaguggcauggagcgccagugcuugccacgacggcauaaacuggcuuacuaucgggauuucuggaccagauaauggugcaguagccguucugaaguauaacggcaucauaacagacaccauuaaguccuggaggaauaacaucuugcggacgcaggagagcgagugugugugcgucaaugggucguguuucacugugaugaccgauggacccucuaacggccaggcuuccuacaaaaucuuucgcauugaaaaggguaaaaucgugaagucagucgagaugaaugccccuaacuaucauuacgaagagugcaguuguuacccagacagcuccgagauuacaugcguuugcagagauaauuggcacgggucuaacaggccgugggugagcuucaaucaaaaccucgaauaucagauaggauacaucuguucaggcauuuuuggcgacaauccccggccuaacgauaaaacugggaguugcggaccaguauccagcaauggugcgaacggcgugaagggguucucuuuuaaguauggaaacggcgucuggaucggucgcaccaaaucaaucaguagccgaaauggguucgagaugauuugggaccccaacggcuggacagaaaccgauaauaacuuuuccauaaagcaggacaucgugggaauuaaugaguggucuggcuacucggggagcuucguucaacauccugaacugacgggacuggacuguaucagaccaugcuucuggguggagcucauuaggggucggcccaaagagaacacuaucuggacauccggcucaaguauaucuuuuuguggggucaauagcaacaccgugggaugguccuggccggauggcgcagaauuaccuuucacuaucgacaaguga

SEQ ID NO: 147823 - RNA, 1410 nt, Artificial Sequence
  derived and/or modified sequence opt3 from neuraminidase__InfluenzaA__AIR93984
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagauuaacgcccccaauuaucauuacgaagagugcaguuguuacccugacagcuccgagauaacuugcgucugccgcgauaacuggcacgggucuaauagaccauggguuagcuucaaccagaaucucgaauaucagaucggauacauuuguucaggcaucuuuggcgacaacccgaggcccaaugauaaaaccgggaguugcggaccuguguccagcaacggugcgaacggcguaaagggguucucuuuuaaguauggaaauggcguguggaucggucggacaaaaucaauuaguagccgcaacggguucgagaugauaugggacccaaauggcuggaccggaacggauaacaauuuuuccaucaagcaagacauugucggcaucaacgaauggucuggguacucggggagcuucgugcagcaucccgagcugacuggucugggcuguauucgaccuugcuucuggguugaacucaucagagggaggccaaaagagaauacaauauggaccuccggaucaaguaucucuuuuuguggcgugaacagcgacacugucgguugguccuggcccgauggggcagaguuaccguucacaauugacaaguga

SEQ ID NO: 147824 - RNA, 1410 nt, Artificial Sequence
  derived and/or modified sequence opt3 from neuraminidase__InfluenzaA__AIR93995
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugccugucaaacuggccggaaauucuucguugugcccagugucagggugggcgauuuacagcaaggacaacaguaucagaauuggcuccaaaggugauguuuuugugaucagggagccguucaucucuuguagccccuuagaaugccggaccuuuuuccugacucagggggcucuacucaaugacaagcauuccaacggaacaauuaaagaucgcucaccuuaucgaacccugaugaguuguccaauaggcgagguccccagcccuuacaacucucguuuugaauccguggccuggucagcaagcgccugccacgacggcaucaauuggcuuacuauugggaucaguggaccagauaacggugcuguagcaguucugaaguauaauggcauaauuacagacaccaucaagucuuggaaaaacaauaucuugagaacgcaagaguccgagugugugugcgucaacgggagcuguuucacugugaugaccgauggacccucgaauggccaggccucuuacaagauuuuuaggaucgaaaaagguaagauugugaaauccgucgagaugaacgcuccuaauuaucauuacgaagagugcucauguuacccagacaguagcgagauaacaugcguuugccgggauaacuggcacggguccaaucgcccgugggugucuuucaaccagaaucucgaauaucagaucggauacauuuguagcggcguauuuggcgacaaccccagaccuaaugauaagacugggucaugcggaccagugaguuccaacggugccaacggcgucaagggguucagcuuuaaauauggaaauggcguguggaucgguaggaccaagucuaucucaagucggaacggguucgagaugauuugggaccccaauggcuggacaggaaccgauaacaauuuuagcauaaaacaagacaucauuggcaucaacgaaugguccggguacucuggaucguucguucagcauccugagcugacggguauggacuguauucgcccaugcuucuggguggaacugauccgaggcagacccaaggagaauacuauauggacaagcggguccucaaucaguuuuuguggagucaacucugauaccgugggcuggagcuggccggacggugcggagcucccuuucacuauugauaaauga

SEQ ID NO: 147825 - RNA, 1401 nt, Artificial Sequence
  derived and/or modified sequence opt3 from neuraminidase__InfluenzaA__AIR94118
augaaccccaaucagaagaucauugccauaggcagcgugucccugaucauugcuaucauuugccuccuuaugcaaaucgcaauacugaccacaacuaugacguugcacuucagacagaacgaguguaauaacucuucaaauaaccaggucaugccuugcgaaccaaucauuaucgagaggaauaccguucauuuaaacaguacaacuauugaacgggagaucuguccgaaaguggccgaauacaagaauuggagcaaaccccagugccaaauaaccggguuugcgccuuucuccaaggacaacucuauucgccugucggcuggaggugauaucuggguaacacgagagccauaugugucauguagccuagacaaaugcuaccaguuugcccucggccaggggaccacucugaagaauaagcacaguaacggaacaacccaugaucguacgccccacagaacucuucugaugaaugaguugggcgucccuuuccaucucgguaccaaacagguguguauugcaugguccucuagcuccugcuaugacgggaaggccuggcugcacaucuguguuacaggagaugacaaaaacgcuacugcaucaaucauuuacaauggcaugcugguggauaguauaggcagcuggucuaagaacauccucaggacccaagaauccgagugcgucuguauuaacgggacaugcgccgugguaaugaccgacggaucagcuagcgguaaagccgauacgcggguuuuauuuaucaaggaaggcaagauaauuaauaucaguccacugucuggguccgcgcagcacguggaggagugcagcuguuauccccgcuacccugaagucagaugcguguguagggacaacuggaaaggaucgaaucggccaauccuuuauauuaacauggcagauuacucuaucgaguccucauacgugugcaguggcuuggucggugacacuccgcgcaaugaugacagcuccucuagcucaaacuguaaggaccccaauagugaacgaggggccccuggaguuaaaggcugggcuuucgaugacggcaacgauguguggauggggagaacaauuaagaauggauccaggagcgguuaugagaccuuucggguagugaacggcuggacugucgccaauucuaaaucacaggugaaccgucagguuauaguggacagugaugacuggagcggguacuccggaaucuucucugucgaaggcaagaaaugcauuaaucgcuguuuuuauguggagcugaucagagguaggccacaagagccccggguaugguggacaucgaacagcaucauuguuuucugcgggaccuccggcacguacggaaccggcucauggccugauggggcaaauauaaacuuuaugccaaucuga

SEQ ID NO: 147826 - RNA, 1410 nt, Artificial Sequence
  derived and/or modified sequence opt3 from neuraminidase__InfluenzaA__AIT38335
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaacuaaucaggugauguugugcgaaccgaccaucauagagagaaacaucacagaaauuguauauuuaaccaauacuacaaucgagaaggaaauuugucccaaacugguggaguacaggaacuggucaaagccucagugcaaaaucaccggguucgcaccauuuaguaaggacaauagcauacggcuauccgccggaggugauauuugggucacgcgcgagcccuaugugucuugugacccugauaagugcuaccaauucgcgcucggccaggggacuacccugaacaaucgacauucgaacgacacaguucacgaucguacuccauauagaacccuucugaugaaugaauugggaauccccuuucaucucggcacaaaacagguguguauugcuuggucaagcaguuccugccacgacgguaaggccuggcugcaugucugugugaccgggcacgaugagaacgcaacggccucuuucaucuacgacggaaggcugguagauagcaucguuuccuggucaaaacggauucuccgcacucaggaaagugagugcguguguauagacggcacaugcaccgucgugaugacugauggcagcgcuucugggagagcagacacaaggaucuuauuuauuaaggagggaaaaaucauacacauuucccaacugucagguagcgcccagcauguggaagagugcaguuguuauccucgguacccaggcguccgcugcguuugucgagauaauuggaaggggucuaacagaccgaucguggacaucaauguaaaggacuacuccauuaacagcucguaugugugcucuggacuugucggcgauacccccaggaaaaacgacuccuucucaaguagcuacuguuugaauccuaacaaugaagagggugggcacggagugaagggcugggcuuuugaugacggcgaugacguuuggauggggcggacgaucaacgaaaaacugcguuccggauaugagaccuucaaggugauuaaagguuggucuaagccaaauagcaaacuacagauaaaccgccaggucaucguggauagaggcaauaggucaggguacaguggaaucuuuuccguagagggcaaggguugcauuaaccgguguuucuauguugaacucauccgagggcgcaagcaagagacagaagugugguggacuagcaauucuauugucguguuuugcggcaccucaggaacauacggcacugggaguuggcccgacggagccaacauaaaucugaugccuaucuga

SEQ ID NO: 147827 - RNA, 1410 nt, Artificial Sequence
  derived and/or modified sequence opt3 from neuraminidase__InfluenzaA__AIT38346
augaaccccaaucagaagaucauuaccauaggcagcaucucccugacaauugccacuaucugcuuccuccuucaaguggcuauucuggucacgaccguuacauugcacuuuaaacaguucgaguguaacccuacuccaaauaaccaggugauguuaugcgaaccgaccguaaucgagagaaauauaacaaagaucguguaccugaccaacacuacagucgaaaaagagauuugucccaagccugcagaauauaggaauuggucuaaaccacagugcaagaucaccggguuugcccccuucucaaaggacaacaguauucggcuaagcgcgggaggugauaucugggugacgcgcgagccuuacguuuccugugcuccaaauaaaugcuaucaauuugcccucggccaggggacuacccugaacaaucgacauucuaacgacacagugcacgaucguacucccuacagaacccuucugaugaaugaguugggaauaccuuuccaucucggcacaaagcaggucuguauugcauggucgucaagcaguugccacgacgguaaagccuggcugcauguguguguaaccgggcacgauaagaacgcuacggcauccuuuaucuaugacggaaggcugguugauucuauuggcagcugguccaaaaauauccuccggacucaggaaucagagugcguguguaucaacggcacaugcaccgucgugaugacugacgggagugccagcggacgcgcugauacaaagauuuuauucauaaaggaagguaaaaucauucacaucucucaacuguccggcucagcccagcauguggaggagugcagcuguuacccaagauauccgggggucaggugcguuugucgggacaacuggaagggaaguaaucgccccauaguggauauuaacguacgagacuacucuaucguguccagcuacgucugcucgggccuugugggugauaccccuaggaaaaaugacucuuuuuccucaagucacuguuugaacccaaauaacgaagaagggggacauggcguuaagggcugggcguucgacgauggggacgauguguggaugggaagaacgaucagcgagaaacugcgguccgguuaugagaccuuuaaggucauuaaaggcuggucuaagcccaauagcaagcuacagaucaaccgucaggugauuguagaccgcgggaauagaucaggauacaguggcauauucuccguugaagguaaaagcugcaucaacagguguuuuuauguggagcucauucgggggcgaaagcaagagacagaagucugguggacuucuaauucaaucguggucuucugcggcaccaguggaacauacggcacugggagcuggccugauggagcagacaucaaccugaugccaauuuga

SEQ ID NO: 147828 - RNA, 1410 nt, Artificial Sequence
  derived and/or modified sequence opt3 from neuraminidase__InfluenzaA__AIT38361
augaaccccaaucagaagaucauuaccauaggcagcaucucccugacaauugccacuaucugcuuccucaugcaaguggcuauucuugucacgaccguuacacugcacuuuaaacaguacgaguguaacucuacuccuaauaaccaggugauguugugcgaaccaaccguaaucgagagaaauauaacaaagaucguguauuuaaccaacacuacagucgugaaagaaguuuguccgaagcccgcagaguacaggaauuggucaaaaccucagugcaagauuaccggguucgccccauuuaguaaggacaacagcauccggcuguccgcgggaggugauauuugggugacgcgcgaacccuaugucucuugugcuccuaauaaaugcuaccaauucgcccuaggccaggggacuacccucaacaaucgacauucgaacgacacagugcacgaucguacuccauauagaacccugcuuaugaaugagcugggaauccccuuucauuugggcacaaagcagguauguauagcauggucaagcaguuccugcuacgacgguaaagccuggcuccacguuugugugaccgggcaugauaagaacgcuacggcaucuuucauuuaugacggaaggcuggucgauagcaucggcuccuggaguaaaaauauucugcggacucaggagucagaaugcguguguaucaacggcacaugcaccguggucaugacugacgggagcgccucuggacgcgcugauacaaagauccucuuuauuaaggaggguaaaauaauccacauuucccaauuaucaggcagcgcccagcacguugaagagugcaguuguuacccuagauacccaggggugaggugcguaugucgggacaacuggaagggaucuaaucgcccgaucguggauauaaacaugcgagacuauuccauugucagcucguacgugugcucuggccugguuggugauacccccagagagaaugacuccuucucaaguagccauugucuuaacccuaauaacgaagaagggggacacggcgugaaaggcugggcguuugacgauggggacgaugucuggaugggaaggacgaucuccgagaaguugcggucugguuaugagaccuucaaagugaucaagggcuggagcaaaccaaauucaaagcugcagauuaaccgucagguaaucguugaccgcgggaauagaaguggauacuccggcauuuuuagcguggaagguaagucuugcauaaacagguguuucuaugucgagcuaauccgggggcgaaaacaagagacagaagugugguggacuucaaauaguauugucguguuuugcggcaccagcggaacauacggcacuggguccuggcccgauggagcagacaucaaccucaugccuaucuga

SEQ ID NO: 147829 - RNA, 1410 nt, Artificial Sequence
  derived and/or modified sequence opt3 from neuraminidase__InfluenzaA__AIT38375
augaaccccaaucagaagaucauuaccauaggcagcgugugcaugacaaucgggauggucaaccugauucuccaaaucggaaauauuaucuccauauggaucucucacucaauucagcuugguaaccagaaucagaucgagauuuguaaccaaaguguuaucacuuacgaaaauaacacgugggugaaucagaccuauguaaacauaagcaauacaaacuucgccgcuggccaguccguggucccugugaaacuggcaggaaauucuucguugugcucaguuagcggaugggccauuuacaguaaggacaacuccaucagaauuggcucuaaaggugauguguuugucaucagggagccauucaucagcuguuccccguuagaaugccggaccuuuuuccugacucagggggcgcuacucaaugacaagcauucaaacggaacaauuaaagaucgcagucccuaucgaacccugaugagcuguccuauaggcgaggugccaucucccuacaacucccguuuugaaucaguagcuuggagcgccagugcaugccacgacggcaucaauuggcuuacuauugggaucucuggaccugauaacggugccguugcugugcugaaguauaauggcauaauuacagacaccaucaaguccuggagaaacaauaucuugaggacgcaagagagcgagugugcaugcgucaacgggucguguuucacugugaugaccgauggaccaucugacggccaggccuccuacaaaauuuuucggaucgaaaaggguaaaauugugaagucagucgagaugaaugcucccaacuaucauuacgaagagugcaguuguuacccugauagcuccgagauaacaugcguuugccgcgacaauuggcacgggucuaacagaccaugggugagcuucaaucagaaccucgaauaucagaucggauacauuuguucaggcaucuuuggcgauaauccgaggcccaacgacaaaacugggaguugcggaccuguauccagcaauggugccaacggcgugaagggguucucuuuuaaguauggaaacggcgucuggaucggucggaccaaaucaauuaguagccgcaauggguucgagaugauaugggauccaaacggcuggacaggaaccgacaauaacuuuuccaucaagcaagacauugugggcaucaaugaauggucuggguacucggggagcuucguucagcaucccgagcugacgggucuggauuguauucgaccuugcuucuggguggaacucaucagaggcaggccaaaagagaacacuauauggacauccgggucaaguaucucuuuuuguggagucaauagcgacaccgugggcugguccuggcccgauggugcggaguuaccguucacuauugacaaguga

SEQ ID NO: 147830 - RNA, 1410 nt, Artificial Sequence
  derived and/or modified sequence opt3 from neuraminidase__InfluenzaA__AIT93148
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacucaucauugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuaucggcgagguaccaucccccuacaacucacguuuugaaagcguugccuggagugcaucugccugccacgacggcaucaacuggcuuacaauugggauauccggaccugauagcggugcuguggcaguccugaaguauaauggcaucauuaccgacacgaucaagucguggagaaacaauauauugaggacucaagagucugagugugccugcgugaacggguccuguuucaccauuaugacagauggaccaucagacggccaggcuaguuacaaaaucuuucggaucgaaaaggguaaaauugucaagagcguggagaugaaugcccccaacuaucauuacgaagagugcuccuguuacccugauucuagcgagaucacuugcguuugccgcgacaauuggcacgggucaaacagaccaugggugaguuucaaucagaaccucgaauaucagauuggauacauauguuccggcguauuuggcgauaauccgaggcccaacgacaaaaccgggagcugcggaccugugucuucaaauggugcgaacggcgucaagggguucaguuuuaaguauggaaauggcguguggaucggucggacaaaaagcauuuccucucgcaagggguucgagaugaucugggauccaaacggcuggaccggaacggacaacaaauuuucgaucaagcaagacauuguuggcauaaaugaauggagcggguacuccggaucauucgugcagcaucccgagcugacuggucuggauuguauccgaccuugcuucugggucgaacucauuagaggcaggccagaggagaacacaaucuggaccagugggucuagcauuuccuuuuguggagugaauagcgacacuguaggcuggagcuggcccgauggugcagaauuaccguucacaaucgacaaauga

SEQ ID NO: 147831 - RNA, 1410 nt, Artificial Sequence; identical to SEQ ID NO: 140656
  derived and/or modified sequence opt3 from neuraminidase__InfluenzaA__AIU39701

SEQ ID NO: 147832 - RNA, 1410 nt, Artificial Sequence; identical to SEQ ID NO: 138754
  derived and/or modified sequence opt3 from neuraminidase__InfluenzaA__AIU39703

SEQ ID NO: 147833 - RNA, 1410 nt, Artificial Sequence
  derived and/or modified sequence opt3 from neuraminidase__InfluenzaA__AIU39705
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaacaccggguccugcggaccugugagcucuaauggugcgaacggcguaaaaggguucucauuuaaguauggaaacggcguguggaucggucggacaaagaguaucagcucccgcaauggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 147834 - RNA, 1413 nt, Artificial Sequence
  derived and/or modified sequence opt3 from neuraminidase__InfluenzaA__AIU46611
augaaccccaaucagaagauuaccugcaucagcgccacaggcaugacucuguccguggucucuaugcucauagggaucgcuaaccuuggacugaauauugguuugcacuacaaaguuggcgacucaacgaacaucaauauuccuaacaugaaugagaccaguccaacaacuaccaucauaaacaaucauccgcaaaacaauuucacaaacaucaccaauauuaucgugacuagaaacgaagaggggcacuuacugaaucuaacaaagccccucugugaaguaaacagcuggcauauucuguccaaagauaacgcaaucaggauaggagaggacgcccacauuaucgugacccgggaaccuuaucuuucuugcgauccacagggcugucgcauguuugcgcugucgcaggguacgacuuugcgagggaagcaugcuaauggaaccauucacgaccguucacccuucagagcccucgucagcugggagaugggccaggcaccuaguccauacaacacaaggguggagugcaucggcugguccucuacuagcugucacgaugggaucucccggaugucaauuugcauaaguggacccaauaacaaugccagcgcuguugugugguaugguggccgcccugucaccgaaaucccaucuugggcagggaacauucugagaacacaagaguccgaaugugugugccauggaggcaucuguccgguaguuaugaccgacggucccgccaauaacagggcugagacgaaaauaauuuacuuuaaggaggggaagaucaaaaagaucgaggaacugaaaggagaugcccagcacauugaagagugcucauguuauggcgcgagcgaaaugaucaagugcauuugccgggacaauuggaaaggcgcaaaccgcccugugauaacuaucgauccagagaugaugacacauaccaguaaguaccucuguucuaagauuuuaacugacacaucccgacccaaugauccuaccaacgggaauugcgaggccccaaucacgggagguagccccgacccgggcgucaaaggguucgcuuuucuggauggagaaaacucguggcuuggcagaaccaucucuaaggacuccaggucagguuaugagauguugaaagugccuaaugccgaaacagacacucagaguggggcaauuagccaccagauaaucgugaacaaccaaaauugguccggcuacucuggagcuuucauugauuacugggccaacaaggaguguuuuaaucccugcuucuaugucgaacugauccggggccguccaaaagagagcucaguucuauggaccaguaacuccauuguggcgcucugugggagcaaggagcgccugggaucuuggucauggcacgacggugccgaaaucauauacuuuaaauga

SEQ ID NO: 147835 - RNA, 1410 nt, Artificial Sequence
  derived and/or modified sequence opt3 from neuraminidase__InfluenzaA__AIV09221
augaaccccaaucagaagaucauuaccauaggcagcgugugcaugacaaucgggauggccaaccugauucuccaaaucggaaauauuacuuccaucuggauaucucacucaauccagauugguaacagaaaucagaucgaggcuuguaaccagagugucauuacguacgaaaauaacaccuggguuaaucaaacauaugugaacaucagcaauacuaacuucgcaguaggccaguccguggucccugugaaacuugccggaaauucuucgcugugcccaguuucagggugggcgauauacagcaaggacaacaguauuaggaucggcuccaaaggugauguguuugucauucgggagccguucaucucuuguagccccuuggaaugccgcaccuuuuucuuaacacagggggcucugcuaaaugacaagcauuccaacggaaccaucaaagaucgaucaccuuaucguacucucaugaguuguccaauuggcgaggugcccagcccuuacaacucuagauuugaauccguagccuggucagcaagcgccugccacgacggcauaaauuggcugacaaucgggauuaguggaccagauaacggugcuguugcagugcuuaaguauaauggcaucauaaccgacacgauuaagucuuggaggaacaauauccugcggacucaggaguccgagugugucugcgugaacgggagcuguuucaccgugaugacagauggacccucgaauggccaagccucuuacaaaaucuuucgcauugaaaaggguaaaaucgucaaguccguugagaugaacgcuccuaauuaucauuacgaagagugcucauguuacccagacaguagcgagauuacuugcgugugcagagauaacuggcacggguccaauaggccguggguaucuuucaaccagaauuuggaauaucagauaggauacaucuguagcggcauuuuuggcgacaacccccggccuaaugauaaaaccgggucaugcggaccagugcccaguaacggugccaacggcgucaagggguucuccuuuaaguauggaaauggcguguggaucggucgcacaaaaagcaucucuucacgaaacggguucgagaugauuugggacccuaauggcuggaccgaaacggauaacgacuuuaguauaaagcaggacaucguuggaauuaaugaguggagcggcuacuccgggucuuucgugcaacauccagaacucacuggacuggauuguaucagacccugcuucugggucgagcugauuaggggucggccgaaagagaacacaaucuggaccucgggcagcuccauaucauuuuguggggugaauaguaacacuguagacuggucuuggccugauggagcggaacuccccuucacaaucgacaaguga

SEQ ID NO: 147836 - RNA, 1410 nt, Artificial Sequence
  derived and/or modified sequence opt3 from neuraminidase__InfluenzaA__AIW60703
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaaaaucacaggguucgcaccauuuaguaaggacaacagcauacggcuauccgccggaggugauauuugggucacccgcgagcccuaugugucuugugacccugauaagugcuaccaauucgcgcucggccaggggacgacucugaauaaccgacauucgaaugacaccguucacgaucguacaccauauagaacucuucugaugaacgaauugggagugcccuuucaucucggcaccaaacaggucuguaucgcuuggucaagcaguuccugccacgacgguaaggccuggcugcauguguguguaacagggcacgaugagaaugcaaccgccucuuucauuuacgacggaaggcugguugauagcaucggcuccuggaguaaaaagauccuccggacgcaggaaucagagugcguguguauuaacggcacuugcacagucgugaugaccgacgggagcgcuucuggacgcgcagauacuaaaauauuauuuaucgaggaagguaagauugugcacaucuccccucugucaggcagcgcccaacaugucgaggaaugcaguuguuauccacaguacucugggguuagaugcguguguagggacaauuggaagggauccaaccggccgauaguagauauuaacgugaaagacuacagcaucgucucgucuuaugugugcuccggccuuguuggugacacaccccgcaagaaugauucaaguagcuccucucacuguuugaacccuaauaacgaggaagggggacauggcgugaaaggcugggcuuucgacgaugggaaugacgucuggaugggacgaaccaucagcgagaagcugagaucagguuacgagacguuuaaagugauuggcggguggaguaagccaaacuccaaacuacagaucaauaggcagguaauuguugaucggggaaaccguagcggcuauucugguauauucucaguggaagggaagaauugcaucaaccgcuguuuuuacgucgagcucauuagaggcaggaagcaagaaaccgaggugugguggacaaguaauagcaucgucguguucugcggaacuuccggcaccuaugggacaggaucuuggcccgacggugccgauaucaaccugaugccuauuuga

SEQ ID NO: 147837 - RNA, 1410 nt, Artificial Sequence
  derived and/or modified sequence opt3 from neuraminidase__InfluenzaA__AIW60704
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaaaaucacaggguucgcaccauuuaguaaggacaacagcauacggcuauccgccggaggugauauuugggucacccgcgagcccuaugugucuugugacccugauaagugcuaccaauucgcgcucggccaggggacgacucugaauaaccgacauucgaaugacaucguucacgaucguaccccauauagaacacuucugaugaacgaauugggagugcccuuucaucucggcacuaaacaggucuguauugcuuggucaagcaguuccugccacgacgguaaggccuggcugcauguguguguaaccgggcacgaugagaaugcaacagccucuuucaucuacgacggaaggcugguugauagcaucggcuccuggaguaaaaagauucuccggacccaggaaucagagugcguguguauaaacggcacgugcacugucgugaugacagacgggagcgcuucuggacgcgcagauaccaaaaucuuauuuauugaggaagguaagaucgugcacauauccccucugucaggcagcgcccaacaugucgaggaaugcaguuguuauccacaguacucugggguuagaugcguguguagggacaauuggaagggauccaaccggccgauuguagauaucaacgugaaagacuacagcaucgucucgucuuaugugugcuccggccuuguuggugacacuccccgcaagaaugauucaaguagcuccucucacuguuugaacccuaauaacgaggaagggggacauggcgugaaaggcugggcuuucgacgaugggaaugacgucuggaugggacgaacaauuagcgagaagcugagaucagguuacgagaccuuuaaagugaucggcggguggaguaagccaaacuccaaacuacagauuaauaggcagguaauaguugaucggggaaaccguagcggcuauucugguaucuucucaguggaagggaagaauugcauuaaccgcuguuuuuacgucgagcucaucagaggcaggaagcaagaaacggaggugugguggaccaguaauagcaucgucguguucugcggaacauccggcacuuaugggaccggaucuuggcccgacggugccgauauuaaccugaugccuauauga

SEQ ID NO: 147838 - RNA, 1410 nt, Artificial Sequence
  derived and/or modified sequence opt3 from neuraminidase__InfluenzaA__AIW60705
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacucuggggucaggugcguuugucgggacaauuggaagggauccaaccgcccgauaguggauauuaacguaaaagacuacagcaucgugucgucuuaugucugcuccggccuugugggugacacaccccgaaagaaugauucaaguagcuccucucacuguuugaacccuaauaacgaggaagggggacauggcguuaaaggcugggccuucgacgaugggaaugacguguggaugggaagaaccaucagcgagaaguuuaggucagguuacgagacguucaaagucauuggcggguggaguaagccaaacuccaaacugcagaucaaucgucaggugauuguagaucggggaaaccgcagcggcuauucugguauauuuucaguugaagggaagaguugcaucaauagauguuucuacguggagcuaauuaggggccggaagcaggaaaccgaggucugguggacaagcaacuccaucguggucuuuugcggaacuucuggcaccuaugggacaggaucguggcccgacggugcggauaucaaucucaugccuauuuga

SEQ ID NO: 147839 - RNA, 1410 nt, Artificial Sequence; identical to SEQ ID NO: 147838
  derived and/or modified sequence opt3 from neuraminidase__InfluenzaA__AIW60706

SEQ ID NO: 147840 - RNA, 1410 nt, Artificial Sequence
  derived and/or modified sequence opt3 from neuraminidase__InfluenzaA__AIW60708
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaaucgacauucgaacgacaccgugcacgaucguacaccauauagaacucuucugaugaaugaauugggaguucccuuucaucucggcaccaaacagguguguaucgccuggucaagcaguuccugccacgacgguaaggcauggcugcaugucugugugacagggcacgaugagaacgccaccgcuucuuucauuuacaauggaaggcugguagacagcaucggcuccuggucaaagaaaauccuccggacgcaggaaagugagugcguuuguauuaacggcacuugcacaguggucaugaccgaugggagcgcaucuggaaaggccgacacuaaaauauuauuuaucgaggaagguaagauugugcacaucuccccucugucaggcagcgcucaacauguggaggaaugcaguuguuauccacgcuacccgggggucagaugcguuuguagggauaacuggaagggaucuaaucggcccauaguggacauuaacguaaaagauuacuccaucgugagcucguaugucugcucuggccuugugggugacacaccucgcaagaaugacuccucaaguagcucccacuguuugaacccaaauaacgaggaagggggacauggcguuaaaggcugggccuucgaugacgggaaugauguguggaugggacgaaccaucucugagaagcugagaagcgguuacgagacguuuaaagucauugaaggcuggucaaaccccaauaguaagcuacagaucaacaggcaagugauuguagaccggggaaauuccagcggguauucuggcauauucucaguugaggguaaaaguugcaucaaccguuguuuuuacguggaacucauucgcgggagaaagcaggagaccgaagucugguggacaagcaauuccaucgugguccugugcggcacuucuggaaccuauggcacagggucguggccugauggagcggacaucaaccuuaugccaauuuga

SEQ ID NO: 147841 - RNA, 1410 nt, Artificial Sequence
  derived and/or modified sequence opt3 from neuraminidase__InfluenzaA__AIW60710
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaccguggauaucaacguaaaagacuacagcauagugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccauuagcgagaagcugcgaucaggcuacgagacauuuaaagucaucgaaggguggaguaagccaaauuccaaacuacagaucaacagacaggugauuguagacaggggaaaucggagcggcuauucugguaucuucucaguugagaguaagagcugcauuaaccguuguuuuuacguggaacucauacgcgggagaaagcaggagacugaaguccuguggaccuccaauucuaucguggucuucugcggcacaucgggaacuuauggcaccgggagcuggcccgauggagcggacauuaaccuuaugccuaucuga

SEQ ID NO: 147842 - RNA, 1410 nt, Artificial Sequence; identical to SEQ ID NO: 136607
  derived and/or modified sequence opt3 from neuraminidase__InfluenzaA__AIW60711

SEQ ID NO: 147843 - RNA, 1410 nt, Artificial Sequence; identical to SEQ ID NO: 136607
  derived and/or modified sequence opt3 from neuraminidase__InfluenzaA__AIW60712

SEQ ID NO: 147844 - RNA, 1410 nt, Artificial Sequence
  derived and/or modified sequence opt3 from neuraminidase__InfluenzaA__AIW60713
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgcuucuuccuauguguguucaggacuggucggcgauacgccccggaagaaugacaguagcuccucuagccauugccuugauccuaacaaugaggaaggugggcacggagugaaaggcugggccuucgacgauggcaacgacguuuggauggggcgcaccauuucagagaaguugcgaaguggauacgagacauuuaaagugaucgaagguugguccaauccaaacagcaagcugcagauuaauagacaggucauaguggauaggggcaaccggucuggguauucaggaaucuucaguguagagggcaaaagcuguauuaaucguugcuuuuacguugaacuaauccgcgguagaaaggaggaaacugaggugcucuggaccuccaacucuaucgucguguucugugggacaucgggcacuuauggaaccggcagcuggcccgacggggcggauauuaaucugaugccuauauga

SEQ ID NO: 147845 - RNA, 1410 nt, Artificial Sequence
  derived and/or modified sequence opt3 from neuraminidase__InfluenzaA__AIW60714
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgcuucuuccuauguguguucaggacuggucggcgauacgccccggaagaaugacaguagcuccucuagccauugccuugauccuaacaaugaggaaggugggcacggagugaaaggcugggccuucgacgauggcaacgacguuuggauggggcgcaccauuucagagaaguugcgaaguggauacgagacauuuaaagugaucgaagguugguccaauccaaacagcaagcugcagauuaauagacaggucauagugggcagggggaaccggucuggauauucaggcaucuucaguguagaggguaaaagcuguauuaaucguugcuuuuacguugaacuaauccgcgggagaaaggaggaaacugaggugcucuggaccuccaacucuaucgucguguucuguggcacaucgggaacuuauggcaccgggagcuggcccgauggagcggacauuaaucugaugccuauauga

SEQ ID NO: 147846 - RNA, 1410 nt, Artificial Sequence
  derived and/or modified sequence opt3 from neuraminidase__InfluenzaA__AIW60715
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaaaagauacugcggacgcaggagagcgaauguguuugcaucaauggcacuuguacaguggucaugaccgauggcucugcuuccgggaaagcagacacuaagauucucuuuaucgaggagggaaagauagugcauacaucaaccuuaagcgguagugcccaacacguggaagagugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgaaaaaucaagauugggauaugagacauuuaaggugauugaggguuggaguaacccaaaauccaagcugcagauaaauaggcaggucaucguggaucggggcaaccguagcggguacucuggaauuuucucaguagaaggcaagaguuguaucaaucgcugcuuuuauguugagcuaaucagagguaggaaagaagagacugaagugcucuggaccagcaacuccauugucguguucugugggacaucuggcacuuacggaaccggcucguggcccgacggggccgauauaaaucugaugccuaucuga

SEQ ID NO: 147847 - RNA, 1410 nt, Artificial Sequence; identical to SEQ ID NO: 138527
  derived and/or modified sequence opt3 from neuraminidase__InfluenzaA__AIW60716

SEQ ID NO: 147848 - RNA, 1410 nt, Artificial Sequence
  derived and/or modified sequence opt3 from neuraminidase__InfluenzaA__AIY54970
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaccgauucaaguagcuccucucauugccuugacccuaauaacgaggaaggugggcacggaguuaaaggcugggcuuucgaugacggcaaugauuuguggauggggcgcacaauuagccagaaccugcgaucaggauacgagacuuuuaaggugaucgaggguuggaguaauccaaacuccaaacuacagauuaauagacaggucauaguggacaggggcaaccggagcggguauucuggaaucuucucaguagaaggcaagaguuguauuaaucguugcuuuuacguugagcucauccgcgguagaaaacaagaaaccgaggugcuguggacaagcaacuccaucgucguguucugugggacuucuggcaccuauggaacaggcucguggcccgauggggccgacauuaaucuuaugccuauauga

SEQ ID NO: 147849 - RNA, 1410 nt, Artificial Sequence
  derived and/or modified sequence opt3 from neuraminidase__InfluenzaA__AIY54974
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugagcgaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaaaagauucugaggacgcaggagucugaaugugugugcauaaacggcacuuguacagucgugaugaccgauggcuccgcuucagggaaagcagacacuaagauccucuuuauugaggagggaaagaucgugcacacaagcaccuuaagugguucugcccaacacgucgaagagugcuccugcuauccucgguacccaggcguucgcugugugugcagagauaauuggaaagggagcaacaggccgauaguagacauuaacaucaaggacuacucgaucgugucuuccuaugucuguucaggacuggugggcgauacgccccggaaaaaugacaguagcuccucuagccauugccuugauccuaacaaugaagagggugggcacggaguuaagggcugggcuuucgacgauggcaacgacguguggauggggcgcaccauuucagaaaaauugcgaaguggauacgagacauuuaaggucaucgaggguugguccaauccaaacagcaaacugcagauuaauagacaggugaagguagauaggggcaaccggucuggguauucaggaauauucaguguugaaggcaagagcuguaucaaucguugcuuuuacguggagcuaauucgcgguagaaaagaagagacuaagguccucuggaccuccaacucuaucguggucuucugugggacaucgggcacuuauggaaccggcagcuggcccgacggggccgauaucaaucugaugccuauuuga

SEQ ID NO: 147850 - RNA, 1410 nt, Artificial Sequence
  derived and/or modified sequence opt3 from neuraminidase__InfluenzaA__AIY54982
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguuucgaucaggauacgagacauucaaagucaucgaagguuggaguaacccaaauuccaaguugcagauuaacagacaggugauaguagauaggggcaaucggagcggguauucuggaaucuuuucaguugagggcaaaaguuguauuaaccguugcuucuacguggaacugauccgcgguagaaaggaggaaacugagguccuauggaccagcaauuccaucguggucuucugugggacaucuggcacuuauggaaccggcucguggcccgacggggccgauauuaaccucaugccuauauga

SEQ ID NO: 147851 - RNA, 1410 nt, Artificial Sequence
  derived and/or modified sequence opt3 from neuraminidase__InfluenzaA__AIY54990
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugggauaacaggauucgcaccauuuuccaaagacaauucuauucggcugucggccgguggcgauaucuggguaacccgcgagcccuaugugucaugcgacccugauaaguguuaccaauucgcgcuagggcagggaacgacucucaacaauguccauagcaacgacaccgugcacgaucgaacaccauaucguacucugcuuaugaaugaacugggcguucccuuucauuuggguaccaaacaggugugcauugcuuggaguuccucuagcugucacgacgggaaggccuggcuccaugucugcgugacaggagaugacaagaacgcaaccgccuccuucaucuacaauggcagacugguagauucaaucguuaguuggagcaaagagauucugaggacgcaggaaucugagugugugugcauaaacggcacuuguacagucgugaugaccgacggguccgcuucaggaaaggcagauacuaaaauccucuuuauugaggaagguaagaucgugcacacaagcaccuuaaguggcucugcccaacacgucgaggaaugcuccugcuauccucgguacccagggguucgcugugugugcagagacaauuggaagggaagcaacaggccgauaguagauauuaacaucaaagacuacucgaucgugucucgguaugucuguuccggccuggugggugacacgccccgcaagaaugauucaaguagcuccucucauugccuugacccuaacaaugaggaagggggacacggcguuaaaggcugggcuuucgaugacgggaacgauguguggaugggacgaaccauuagcgagaagucaagaagugguuacgagacauuuaaagucaucgaaggcugguccaauccaaacagcaaguugcagauuaauaggcaagugauaguagaccgggggaaccguucuggauauucaggcaucuucaguguugaggguaaaagcuguauuaaucgcugcuuuuacguggaacugaucagagggaggaaggaggaaacugagguccuauggaccuccaacucuaucguggucuucuguggcacaucgggaacuuauggcaccgggagcuggcccgauggagccgacauuaaucucaugccuauauga

SEQ ID NO: 147852 - RNA, 1401 nt, Artificial Sequence
  derived and/or modified sequence opt3 from neuraminidase__InfluenzaA__AJD78177
augaaccccaaucagaagaucauugccauaggcagcgugucccugaucauugcugucaucugccuccuuaugcaaauugcaauccugaccacaacuaugacguugcacuucaugcagaacgaguguucuaauccuucaaacaaucagguuaugccaugcgaaccgauaaucauugagagaaacaccgugcauuuaaauaacacaacuaucgaaagggagauuugucccaaagccgcggaauacaagaauuggaguaaaccucagugccaaaucaccggguuugcuccauucagcaaggacaacuccauacggcugucugccggaggugauauuuggguaacacgcgagcccuaugugucguguucacuagacaaaugcuaccaguuugcacucggccaggggaccacucugaagaauaagcacagcaacggaacaacccaugaucgaacgccucaccguacucuucugaugaaugaguugggcgucccauuccaucucgguaccaaacagguguguaucgccuggaguuccucuagcugcuaugacgggaaggcuuggcugcacauuuguguuacaggagaugacaaaaacgcaacugccuccaucaucuacgauggcaugcugguggacucaauuggcaguuggagcaagaauauacucagaacccaagaaucugagugcgucuguaucaacgggacaugcgcugugguaaugaccgauggauccgccucagguaaagcggacacgaggguuuuauuuauucgggaaggcaagaucauaaacauuagcccccugagugggucugcacagcacguggaggagugcuccuguuauccucgcuacccagaagucagaugcguguguagggauaauuggaagggaagcaaccggccgauccuuuauaucaauauggccgacuacucgauugagucuuccuacgugugcucaggcuuggucggugauacuccccgcaacgacgacaguagcuccucuagcaauugucgagauccuaacaaugaaagaggggcuccaggaguuaaaggcugggccuucgacgauggcaacgacguguggauggggaggacaaucaagaauggaucacggagugguuaugagaccuuucguguagugaacggcuggacuauggcaaauuccaaaagccagauuaaccgccaggucauaguggauucugacgauuggucaggguacaguggaaucuucagcguugaaggcaagaaaugcauuaauagauguuuuuauguggagcugaucaggggucggccccaagagccucgagucugguggacauccaacucuaucauuguguucugcgggaccucgggcacguacggaaccggcagcuggccagacggggcuaauauaaacuuuaugcccaucuga

SEQ ID NO: 147853 - RNA, 1401 nt, Artificial Sequence
  derived and/or modified sequence opt3 from neuraminidase__InfluenzaA__AJD78189
augaaccccaaucagaagaucauugccauaggcagcgugucccugaucauugcuaucauuugccuccuuaugcaaaucgcaauacugaccacaacuaugacguugcacuucagacagaacgaguguaauaacucuucaaauaaccaggucaugccuugcgaaccaaucauuaucgagaggaauaccguucauuuaaacaguacaacuauugaacgggagaucuguccgaaaguggccgaauacaagaauuggagcaaaccccagugccaaauaaccggguuugcgccuuucuccaaggacaacucuauucgccugucggcuggaggugauaucuggguaacacgagagccauaugugucauguagccuagacaaaugcuaccaguuugcccucggccaggggaccacucugaagaauaagcacaguaacggaacaacccaugaucguacgucccacagaacucuucugaugaaugaguugggcguccccuuccaucucgguaccaaacagguguguauugcauggucuagcuccucaugcuaugacgggaaggccuggcugcacaucuguguuacaggagaugacaaaaacgcuacugcaaguaucauuuacaauggcaugcugguggauagcauaggcucuugguccaagaacauccucaggacccaagaaucagagugcgucuguauuaacgggacaugcgccgugguaaugaccgacggaagcgcuagugguaaagccgauacgcggguuuuauuuauccgcgaaggcaagauaauuaauaucucuccucuguccgggagcgcgcagcacguggaggagugcucguguuauccaagauaccccgaagucaggugcgugugucgggacaacuggaagggaucuaaucgcccuauccuuuauauuaacauggcagauuacuccaucgagucaaguuacgugugcagcggcuuggucggugacacuccacgaaaugaugacuccucuagcucaaguaacuguaaagaccccaauuccgaaagaggggccccgggaguuaagggcugggcuuucgaugacggcaacgauguguggauggggaggacaauuaaaaauggaagccggucugguuaugagaccuuucguguacugaacggcuggacuguggccaauucaaagagucagauaaaccgccaggucaucguggacagcgaugacugguccggguacucuggaauuuucucgguugaaggcaaaaagugcaucaauagauguuuuuauguggagcuaaucaggggucggccucaagagccacgagucugguggacaagcaacuccauuauaguguucugcgggaccucaggcacguacggaaccggcaguuggcccgauggggcaaauaucaacuuuaugccuauuuga

SEQ ID NO: 147854 - RNA, 1401 nt, Artificial Sequence
  derived and/or modified sequence opt3 from neuraminidase__InfluenzaA__AJD78201
augaaccccaaucagaagaucaccgccauuggcagcgugucccugauaaucgcuauuaucugccuccuuaugcaaauugcaauccugacaacuacgaugaccuugcacuucagacagaaagaguguucuaacccuucaaauaaccaggucaugccaugcgaaccgauaaucauugagaggaauacaguucauuuaaacaguacuaccaucgaacgggagauuugucccaagguggccgaauacaaaaauuggagcaagccucagugccugaucacaggguuugcgccauucuccaaagacaacucuauacgccuaucggcuggaggugauauuuggguaacccgagagcccuaugugucauguagcccugacaagugcuaccaauuugcccucggccaggggacuacacugaagaauaaacacaguaacggaaccacgcaugaucguacuccacacagaacccuucugaugaaugaguugggcguccccuuccaucucgguacaaaacagguguguaucgcaugguccucuagcuccugcuaugacgggaaggccuggcugcacauuuguguuacuggagaugacaagaacgcuaccgcaucaaucaucuacgauggcaugcugguggacaguauuggcagcuggucuaaaaauauacucaggacacaggaauccgagugcgucuguaucaacgggaccugcgccgugguaaugacggauggaucagcuagcgguguugccgacacucggguguuauuuauucgcgaaggcaagaucauaaauauuagaccucugagugggucugcgcaacacgucgaggagugcuccuguuauccaagguacccggaagugcggugcgugugucgcgauaacuggaagggaagcaaccgacccaucaucuauauuaauauggcagacuacucgaucgagucuuccuacgucugcucaggccuuguuggugauacaccuagaaacgacgacaguagcuccucuagcaauuguagggauccaaacaaugaacguggggcccccggagugaaaggcugggcuuucgacgauggcaacgacguauggauggggcggaccauuaagaauggaucacgcagugguuaugagacuuuuagagugauaaacggcuggacaauggccaauuccaaaagccagaucaacaggcaggucauuguggauucugacgauuggucaggguacaguggaaucuucagcguugaaggcaagaaaugcaucaaucgguguuuuuauguggaguugauucgaggucgcccucaggagccaagagucugguggaccuccaacucuauaaucguguucugcgggacgucgggcaccuacggaacaggcagcuggcccgacggggcaaauauuaacuuuaugccgaucuga

SEQ ID NO: 147855 - RNA, 1401 nt, Artificial Sequence
  derived and/or modified sequence opt3 from neuraminidase__InfluenzaA__AJD78213
augaaccccaaucagaagaucaccgccauuggcagcgugucccugauaaucgcuauuaucugccucuucaugcaaauugcaauccuuacaacuacgaugacccugcacuuuagacagaaagaguguucuaacccuucaaauaaccaggucaugccaugcgaaccgauaaucauugagaggaauacaguucauuugaacaguacuaccaucgaacgggagauuugucccaagguggccgaauacaaaaauuggagcaagccucagugcuuaaucacaggguucgcgccauuuuccaaagacaacucuauacgccugucggcuggaggugauauuuggguaacccgagagcccuaugugucauguagcccugacaagugcuaccaauucgcccuaggccaggggacuacacucaagaauaaacacaguaacggaaccacgcaugaucguacuccacacagaacccugcuuaugaaugagcugggcguccccuuucauuuggguacaaaacagguguguaucgcaugguccucuagcuccugcuaugacgggaaggccuggcuccacauuuguguuacuggagaugacaagaacgcuaccgcaucaaucaucuacgauggcaugcugguggacaguauuggcagcuggucuaaaaauauacugaggacacaggaauccgagugcgucuguaucaacgggaccugcgccgugguaaugacggauggaucagcuagcgguguugccgacacucggguccucuucauucgcgaaggcaagaucauaaauauuagaccuuuaagugggucugcgcaacacguggaggagugcuccuguuauccaagguacccggaagugcggugcgugugucgcgauaacuggaagggaagcaaccgacccaucaucuauauuaauauggcagacuacucgaucgagucuuccuacgucugcucaggccugguuggugauacaccuagaaacgacgacaguagcuccucuagcaauuguagggauccaaacaaugaacguggggcccccggagugaaaggcugggcuuuugacgauggcaacgacguauggauggggcggaccauuaagaauggaucacgcagugguuaugagacuuucagagugauaaacggcuggacaauggccaauuccaaaagccagaucaacaggcaggucauuguggauucugacgauuggucaggguacaguggaaucuuuagcguugaaggcaagaaaugcaucaaucgguguuucuauguggagcuuauucgaggucgcccucaggagccaagagucugguggaccuccaacucuauaaucguguuuugcgggacgucgggcaccuacggaacaggcagcuggcccgacggggcaaauauuaacuucaugccgaucuga

SEQ ID NO: 147856 - RNA, 1410 nt, Artificial Sequence; identical to SEQ ID NO: 144938
  derived and/or modified sequence opt3 from neuraminidase__InfluenzaA__AJI80140

SEQ ID NO: 147857 - RNA, 1410 nt, Artificial Sequence; identical to SEQ ID NO: 144938
  derived and/or modified sequence opt3 from neuraminidase__InfluenzaA__AJI80152

SEQ ID NO: 147858 - RNA, 1410 nt, Artificial Sequence; identical to SEQ ID NO: 147714
  derived and/or modified sequence opt3 from neuraminidase__InfluenzaA__AJI80164

SEQ ID NO: 147859 - RNA, 1410 nt, Artificial Sequence; identical to SEQ ID NO: 147653
  derived and/or modified sequence opt3 from neuraminidase__InfluenzaA__AJI80175

SEQ ID NO: 147860 - RNA, 1410 nt, Artificial Sequence; identical to SEQ ID NO: 147653
  derived and/or modified sequence opt3 from neuraminidase__InfluenzaA__AJI80187

SEQ ID NO: 147861 - RNA, 1410 nt, Artificial Sequence; identical to SEQ ID NO: 147653
  derived and/or modified sequence opt3 from neuraminidase__InfluenzaA__AJI80199

SEQ ID NO: 147862 - RNA, 1410 nt, Artificial Sequence; identical to SEQ ID NO: 147653
  derived and/or modified sequence opt3 from neuraminidase__InfluenzaA__AJI80211

SEQ ID NO: 147863 - RNA, 1410 nt, Artificial Sequence; identical to SEQ ID NO: 145887
  derived and/or modified sequence opt3 from neuraminidase__InfluenzaA__AJI80223

SEQ ID NO: 147864 - RNA, 1410 nt, Artificial Sequence; identical to SEQ ID NO: 147653
  derived and/or modified sequence opt3 from neuraminidase__InfluenzaA__AJI80235

SEQ ID NO: 147865 - RNA, 1410 nt, Artificial Sequence; identical to SEQ ID NO: 145887
  derived and/or modified sequence opt3 from neuraminidase__InfluenzaA__AJI80247

SEQ ID NO: 147866 - RNA, 1410 nt, Artificial Sequence; identical to SEQ ID NO: 147672
  derived and/or modified sequence opt3 from neuraminidase__InfluenzaA__AJI80259

SEQ ID NO: 147867 - RNA, 1410 nt, Artificial Sequence; identical to SEQ ID NO: 144162
  derived and/or modified sequence opt3 from neuraminidase__InfluenzaA__AJI80271

SEQ ID NO: 147868 - RNA, 1410 nt, Artificial Sequence; identical to SEQ ID NO: 147653
  derived and/or modified sequence opt3 from neuraminidase__InfluenzaA__AJI80283

SEQ ID NO: 147869 - RNA, 1410 nt, Artificial Sequence
  derived and/or modified sequence opt3 from neuraminidase__InfluenzaA__AJI80306
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcucgaccgaacacccuaucguacucugcuuaugaaugaacugggcguuccuuuucacuuggguaccaaacaggugugcauugcuuggagcaguuccucuugucaugaugggaaggccuggcuccacgucugcaucacaggagacgauaagaacgcaaccgccagcuucaucuacaauggcagacugguggacuccguaguuucauggaguaaagagauucugaggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccacgguacccggggguucgcugugugugcagagauaacuggaagggauccaauaggcccauaguagacauuaacaucaaagaucacagcaucgugucgucuuacgucuguuccggccuggugggugacacgccucggaagaaugacucaaguagcuccucucauugccuugauccaaacaaugaggaagggggacacggcguuaaaggcugggcuuucgacgaugggaacgacguguggaugggacgcaccauuaaugagacaagccgauuggguuaugagacuuuuaaggucaucgaaggcuggucaaaccccaaaaguaagcugcagauuaauaaacaggugauaguagauagaggggacagguccggauacagcggcaucuucucuguugaggguaagucauguauuaaccggugcuuuuauguggaacuaauccgugggcgcaaggaggaaaccgagguccucuggacaaguaauagcaucguggucuucuguggcacuuccggaaccuacggcacagggucuuggccugauggagccgaccugaaccuuaugccaauuuga

SEQ ID NO: 147870 - RNA, 1410 nt, Artificial Sequence
  derived and/or modified sequence opt3 from neuraminidase__InfluenzaA__AJI80318
augaaccccaaucagaagaucauuaccauaggcagcgugugcaugacaaucgggauggccaaccugauucuccaaaucggaaauauuaucuccauauggaucucucacucaauucagcuugguaaccagagucagaucgaggcuuguaaucaaaacgucauuacuuacgaaaauaacacguggguuaaucagaccuaugugaacaucagcaauacaaacuucgcaacuggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauuccggugcuguugcagugcugaaguauaacggcauuaucaccgacacgauaaagagcuggaaaaauaacauuuugagaacucaagagucggagugugccugcgucaaugggucuuguuucaccaucaugacagauggaccauccgacggccaggcuucauacaagaucuuuaggauugaaaaagguaagaucgugaaaaguguggagaugaacgcccccaauuaucauuacgaagagugcagcuguuacccugauuccucugagauuacuugcgucugccgggacaacuggcacgggagcaaucgcccauggguuucauucaaccagaaucucgaauaucagauaggauacaucuguaguggcguguuuggcgauaacccgagacccaaugacaagaccggguccugcggaccuguaagcucuaacggugcgaauggcgugaagggguucucauuuaaauauggaaacggcgucuggauugguaggacaaagaguaucagcucccggaaaggguucgagaugaucugggauccaaacggcuggaccggaacggacaauaacuuuucuauuaagcaagacauagugggcaucaaugaauggucgggguacagcggauccuucguucagcaucccgagcugacuggucuggauuguauucgcccuugcuucuggguggaacucauccgaggcagaccaaaagagaacacaauuuggaccucagggaguucuaucagcuuuuguggagucaauuccgacacugugggcuggucauggcccgauggugcagaguuaccguucacaauagacaaguga

SEQ ID NO: 147871 - RNA, 1410 nt, Artificial Sequence
  derived and/or modified sequence opt3 from neuraminidase__InfluenzaA__AJI80329
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauagcggugcuguugcagugcugaaguauaauggcauuaucaccgacacgauaaagucguggaaaaacaauauuuugagaacucaagagucugagugugccugcgucaacggguccuguuucaccaucaugacagauggaccaucagacggccaggcuaguuacaagaucuuuaggauugaaaaagguaagaucgugaaaagcguggagaugaaugcccccaacuaucauuacgaagagugcuccuguuacccugauucuagcgagauuacuugcgucugccgggacaauuggcacgggucaaaccgcccauggguuaguuucaaucagaaccucgaauaucagauaggauacaucuguuccggcguguuuggcgauaauccgagacccaacgacaagaccgggagcugcggaccuguaucuucaaauggugcgaacggcgugaagggguucaguuuuaaauauggaaauggcgucuggauugguaggacaaagagcaucuccucucggaaaggguucgagaugaucugggauccaaacggcuggaccggaacggacaacaauuuuucgauuaagcaagacauagugggcaucaacgaauggagcggguacuccggaucauucguucagcaucccgagcugacuggucuggauuguauucgcccuugcuucuggguggaacucauccgaggcagaccaaaagagaauacaauuuggaccagugggucuagcaucuccuuuuguggagucaacucagacacugugggcuggagcuggcccgauggugcagaguuaccguucacaauagacaaguga

SEQ ID NO: 147872 - RNA, 1410 nt, Artificial Sequence
  derived and/or modified sequence opt3 from neuraminidase__InfluenzaA__AJI80340
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauagcggugcuguagcaguucugaaguauaauggcaucauaaccgacacgauuaagucguggaaaaacaauaucuugagaacucaagagucugagugugccugcgugaacggguccuguuucaccaucaugacagauggaccaucagacggccaggcuaguuacaagauuuuuaggaucgaaaaagguaagauugucaaaagcguggagaugaaugcccccaacuauuacuacgaagagugcuccuguuauccugauucuagcgagauaacuugcgugugccgggacaauuggcaugggucaaaccgcccaugggucaguuucaaucagaaccucgaauaccagaucggauauauuuguuccggcaucuuuggcgauaauccgagacccaacgacaagaccgggagcugcggaccuguuucuucaaauggugcgaacggcgugaagggguucaguuuuaaauacggaaauggcguauggaucgguaggacaaagagcauuuccucucggaaaggguucgagaugauaugggauccaaacggcuggaccggaacggacaacaauuuuucgaucaagcaagacauugugggcaucaacgaauggagcggguauuccggaucauucguccagcaccccgagcugacuggucuggauuguauucgcccuugcuucuggguggaacucauccgaggcagaccaaaagagaauacaauauggaccagugggucuagcaucuccuuuuguggaguuaacucagacacugugggcuggagcuggcccgauggugcagaguuaccguucacaauugacaaguga

SEQ ID NO: 147873 - RNA, 1410 nt, Artificial Sequence; identical to SEQ ID NO: 144162
  derived and/or modified sequence opt3 from neuraminidase__InfluenzaA__AJI80351

SEQ ID NO: 147874 - RNA, 1410 nt, Artificial Sequence
  derived and/or modified sequence opt3 from neuraminidase__InfluenzaA__AJI80363
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacccgcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacguccauucaaauaacaccgcucgagaccguacaccauauagaacucugcuuaugaaugaacugggcgugcccuuucacuuggguaccaagcagguuugcauugccuggagcaguuccucuugucaugaugggaaagcauggcuccacgugugcaucacaggagacgauaagaacgccaccgcuagcuucaucuacaauggcaggcuggucgacuccgugguaucauggaguaaagagauucugcggacgcaggaaagcgaguguguuugcauaaacggcacuuguacaguggucaugaccgaugggucugcauccggaaaggccgacacuaaaauccucuuuauugaggaagguaagaucgugcauacaucaaccuuaagcggcggggcucaacacguggaggaaugcaguugcuauccucgcuacccaggagucagauguguuugcagggauaacuggaagggcucuaaucggccgauaguggacauuaacaucaaagaucacuccaucguaagcucguacguguguucuggucuggucggggacacgccccgcaagaaugacuccucaaguagcucccauugccuuaacccuaauaacgaggaaggaggccacggcgugaaagggugggccuucgaugacggaaaugauguuuggaugggucgaaccauuaacgagacaucuagauugggcuaugagacuuuuaaggugaucgaaggguggagcaauccaaaaucaaagcugcagauuaacaggcaggucauaguggaccggggagaucguaguggcuacuccgguaucuucagcguagaggggaaaucuuguauuaaucgcugcuuuuauguugaacuaaucagaggcaggaaggaggaaaccgaggugcucuggacaucaaacaguaucgucguguucuguggaacuagcggcaccuacgggacaggauccuggcccgacggugcggaucugaaucuuaugccuauuuga

SEQ ID NO: 147875 - RNA, 1410 nt, Artificial Sequence
  derived and/or modified sequence opt3 from neuraminidase__InfluenzaA__AJI80375
augaaccccaaucagaagaucauuaccauaggcagcgugucccugacaaucucuacuauuugccucuucaugcagaucgccauucuuaucacgaccgucacacugcacuuuaaacagcaugaguucaacucaccuccaaauaaccagguuauguugugugaaccgacuauaaucgagagaaauauuaccgaaaucguguacuuaacaaacaccacuauugagaaggaaaucugccccaaaccugcugaguauaggaauuggaguaagccacagugugggauaacaggauuugcacccuucagcaaagacaacuccauucggcugucugccgguggcgauaucuggguaacccgcgagccuuacgugucgugcgacccagauaaguguuaucaauuugcgcuagggcagggaacgacucucaauaacguccacucaaauaacaccgugcgagaccguacacccuacagaacucugcuuaugaaugaacugggcguuccuuuccauuuggguaccaaacaggugugcauugcuuggagcaguuccucuugucacgaugggaaggccuggcuccaugucugcaucacaggagacgauaagaacgcaaccgccagcuuuaucuauaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuucauugaggaagguaagaucgugcacacaucaaccuuaagcggcagugcccaacacgucgaggaaugcucuugcuacccacgcuauccggggguuagaugugugugcagggauaacuggaagggauccaaucggcccauaguagacauuaacaucaaagaucauagcaucgugucgucuuacgucuguuccggccuggugggugacacgccucgcaagaaugacucaaguagcuccucucacugccuugauccaaacaaugaggaagggggacauggcguuaaaggcugggcuuuugacgaugggaacgacguguggaugggacgaaccauuaaugagacaagcagauuggguuacgagacuuucaaggucaucgaaggcuggucaaaccccaaaaguaagcugcagauuaauaggcaagugauaguagaucguggggaccgguccggauauagcggcaucuuuucuguugaggguaaaucauguauuaaccgcugcuucuacguggaacuaaucagagggaggaaggaggaaaccgagguccucuggacaaguaauagcaucguggucuuuuguggcacuuccggaaccuauggcacagggucuuggccugauggagccgaccugaaccuuaugccaauuuga

SEQ ID NO: 147876 - RNA, 1410 nt, Artificial Sequence; identical to SEQ ID NO: 147692
  derived and/or modified sequence opt3 from neuraminidase__InfluenzaA__AJI80387

SEQ ID NO: 147877 - RNA, 1410 nt, Artificial Sequence; identical to SEQ ID NO: 147692
  derived and/or modified sequence opt3 from neuraminidase__InfluenzaA__AJI80398

SEQ ID NO: 147878 - RNA, 1410 nt, Artificial Sequence; identical to SEQ ID NO: 147692
  derived and/or modified sequence opt3 from neuraminidase__InfluenzaA__AJI80409

SEQ ID NO: 147879 - RNA, 1410 nt, Artificial Sequence; identical to SEQ ID NO: 147692
  derived and/or modified sequence opt3 from neuraminidase__InfluenzaA__AJI80420

SEQ ID NO: 147880 - RNA, 1410 nt, Artificial Sequence; identical to SEQ ID NO: 147692
  derived and/or modified sequence opt3 from neuraminidase__InfluenzaA__AJI80431

SEQ ID NO: 147881 - RNA, 1410 nt, Artificial Sequence; identical to SEQ ID NO: 147687
  derived and/or modified sequence opt3 from neuraminidase__InfluenzaA__AJI80442

SEQ ID NO: 147882 - RNA, 1410 nt, Artificial Sequence; identical to SEQ ID NO: 147692
  derived and/or modified sequence opt3 from neuraminidase__InfluenzaA__AJI80454

SEQ ID NO: 147883 - RNA, 1410 nt, Artificial Sequence; identical to SEQ ID NO: 147687
  derived and/or modified sequence opt3 from neuraminidase__InfluenzaA__AJI80465

SEQ ID NO: 147884 - RNA, 1410 nt, Artificial Sequence; identical to SEQ ID NO: 147692
  derived and/or modified sequence opt3 from neuraminidase__InfluenzaA__AJI80477

SEQ ID NO: 147885 - RNA, 1410 nt, Artificial Sequence; identical to SEQ ID NO: 147692
  derived and/or modified sequence opt3 from neuraminidase__InfluenzaA__AJI80488

SEQ ID NO: 147886 - RNA, 1410 nt, Artificial Sequence; identical to SEQ ID NO: 147714
  derived and/or modified sequence opt3 from neuraminidase__InfluenzaA__AJI80499

SEQ ID NO: 147887 - RNA, 1410 nt, Artificial Sequence; identical to SEQ ID NO: 147692
  derived and/or modified sequence opt3 from neuraminidase__InfluenzaA__AJI80510

SEQ ID NO: 147888 - RNA, 1410 nt, Artificial Sequence; identical to SEQ ID NO: 147714
  derived and/or modified sequence opt3 from neuraminidase__InfluenzaA__AJI80521

SEQ ID NO: 147889 - RNA, 1410 nt, Artificial Sequence
  derived and/or modified sequence opt3 from neuraminidase__InfluenzaA__AJJ98767
augaaccccaaucagaagaucauuaccauaggcagcgugucccugacaaucucuacuauuugcuucuuuaugcagaucgccauucucaucacgaccgucacacuucacuucaaacaguacgaguuuaacucaccuaguaauaaccagguuaugcugugugaaccaacuauaaucgagagaaauauuaccgaaaucguguauuugacaaacaccacuauugagaaggaaaaaugcccgaagcccgcugaguacaggaauuggagcaaaccucagugugacaucacaggguucgcaccauuuuccaaggauaacucuauacgguuaucggccggaggugacauuuggguaacccgcgagcccuaugugucaugcgauccugacaaguguuaccaauucgcgcugggccaggggacgacucuaaauaacguccauagcaauaacaccgugcgagaucguacaccauauagaacucuccugaugaaugaacuuggaguucccuuucaccugggcaccaaacaggugugcaucgcuuggaguuccucuagcugucaugacgguaaggccugguugcacgucugcauuacaggggaugacaaaaacgcaaccgccuccuucaucuacaauggaaggcucguggauucaguaguuaguuggagcaaggagauccugcggacgcaggaaucugagugugugugcauuaacggcacuuguacagucgugaugaccgacggcuccgcuucagggaaagcagauacuaagauacuguuuaucgaggaaggaaagauugugcauacaagcacccucagugguucugcccaacacgucgaggaaugcuccugcuauccucgcuacccaggcguuagaugugugugcagggacaacuggaaagggagcaaucggccgaucguagauauaaacauuaaggaccacucgaucgugucuuccuacgucuguucaggauuagugggcgacacgccccgcaaaaaugauaguagcuccucuagccauugccuggacccuaacaaugaggaaggugggcacggaguuaagggcugggcuuucgaugacggcgaugacguguggauggggcgaaccaucucagagaaaaguagacuuggauaugagacauuuaaggucauugaagguugguccaacccaaaaagcaaguugcagaucaauaggcaagugauuguagaucggggcaaccguucuggguacucaggaauauucaguguugagggcaagagcuguaucaaucgcugcuuuuauguggaacugauuagagguaggaaagaggaaacugacguccuauggaccuccaacucuaucguggucuucugugggacaucgggcacuuacggaaccggcagcuggcccgauggggccgacaucaaucucaugccuauuuga

SEQ ID NO: 147890 - RNA, 1410 nt, Artificial Sequence
  derived and/or modified sequence opt3 from neuraminidase__InfluenzaA__AJJ98779
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaaccugcugaguacaggaauuggaguaagccacagugugacaucaccggguucgcacccuuuagcaaagauaacuccauacgguuaucugccggaggugacauuuggguaacgcgcgagccuuaugugucgugcgauccagacaaguguuaccaauucgcgcugggccaggggacuacccuaaauaacguccauucaaaugauacagugcgagaccguacucccuauagaacccuccugaugaacgaacuuggaguuccuuuucaccugggcacaaaacaggugugcaucgcuuggagcaguuccucuugucaugaugguaaggccugguugcacgucugcauuaccggggacgauaagaaugcaacggccagcuucaucuacaacggaaggcucguggacuccaucguaucauggacuaaagagauucugcggacacaggaaagugaguguguuugcauaaauggcaccuguacuguggucaugacagauggcagcgcuucugggaaggcagacaccaaaauccuguuuauugaggaaggaaagaucgugcauacguccacccucucagguagcgcccaacacguggaggaaugcaguugcuauccacgcuacccgggcgucagauguguuugcagggauaacuggaaggggucuaaccggcccauaguggacauuaauaucaaagaccacuccaucguaagcucguacguguguucuggauuagucggcgauacaccucgcaagaacgacuccucaaguagcucccauugccuggauccaaauaacgaggaaggugggcacggagugaaaggcugggcuuucgacgauggcaaugacguuuggauggggcgaacuauuucugagaagaguagacuuggauaugagaccuuuaaagugaucgaagguuggucaaaccccaagaguaaauugcagauuaauaggcaggucauaguggaucggggcaaccguuccggguacagcggaaucuucucuguagagggcaagucauguauuaaucgcugcuuuuauguugaacugaucagagguaggaaggaggaaacagaggugcuauggacuagcaacagcaucgucguguucugugggaccuccggcacauacggaaccggcucuuggccugacggggccgauauuaaucucaugccaauauga

SEQ ID NO: 147891 - RNA, 1410 nt, Artificial Sequence; identical to SEQ ID NO: 144162
  derived and/or modified sequence opt3 from neuraminidase__InfluenzaA__AJJ98791

SEQ ID NO: 147892 - RNA, 1410 nt, Artificial Sequence
  derived and/or modified sequence opt3 from neuraminidase__InfluenzaA__AJJ98803
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaaggugcgagaccguacccccuauagaacacuccugaugaaugaacuuggcguuccuuuucaccuggguacuaaacaggugugcauugcuuggagcaguuccucuugucaugaugggaaggccugguugcacgucugcaucaccggagacgauaaaaacgcaacagccagcuucaucuacaauggcaggcucguggacuccguaguuucauggaguaaggagauucugcggacccaggaaagcgagugugugugcauaaacggcacguguacugucgugaugacagaugggucugcuuccggaaaagcagacaccaagauccuguuuauugaggaagguaagaucgugcauacuucaacacucagcggcagugcccaacacgucgaggaaugcucuugcuauccacgcuacccggggguuagaugugugugcagggauaacuggaaaggauccaaucggcccauaguagacauuaacaucaaggaucacagcaucgugucgucuuacgucuguuccggcuuagugggugacaccccucgcaaaaaugacucaaguagcuccucucauugccuggauccaaacaaugaggaagggggacacggcguuaagggcugggcuuucgacgaugggaacgacguguggaugggacgaacgauuaaugagaccagcagacuugguuaugagacauuuaaagucaucgaaggcuggucaaaccccaagaguaaauugcagauuaauaggcaagugauaguagaucguggggaccgguccggauacagcggcaucuucucuguugaggguaagucauguauuaaccgcugcuuuuauguggaacugaucagagggaggaaggaggaaacugagguccuauggaccaguaauagcaucguggucuucuguggcacauccggaacuuacggcaccgggucuuggccugauggagccgaccucaaccugaugccaauuuga

SEQ ID NO: 147893 - RNA, 1410 nt, Artificial Sequence; identical to SEQ ID NO: 144162
  derived and/or modified sequence opt3 from neuraminidase__InfluenzaA__AJJ98815

SEQ ID NO: 147894 - RNA, 1410 nt, Artificial Sequence
  derived and/or modified sequence opt3 from neuraminidase__InfluenzaA__AJJ98827
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacaauaucgugagcucguacgucuguucuggcuuagugggugacacgccucgcaagaacgacuccucaaguagcucccauugccuggauccaaauaacgaggaagggggacacggcguuaaaggcugggcuuucgacgaugggaaugacguguggaugggacgaaccauuaacgagacaucuagacuugguuaugagacuuuuaaggucaucgaaggcuggagcaaucccaaaucaaaguugcagauuaacaggcaagugauaguagaucguggggaccggaguggauacuccggcaucuucagcguugaggguaaaucuuguauuaaucgcugcuuuuauguggaacugaucagagggaggaaggaggaaaccgagguccuauggacaucaaacaguaucguggucuucuguggcacuagcggaaccuacggcacaggguccuggccugauggagccgaccucaaucugaugccaauuuga

SEQ ID NO: 147895 - RNA, 1410 nt, Artificial Sequence; identical to SEQ ID NO: 143159
  derived and/or modified sequence opt3 from neuraminidase__InfluenzaA__AJJ98839

SEQ ID NO: 147896 - RNA, 1410 nt, Artificial Sequence; identical to SEQ ID NO: 141534
  derived and/or modified sequence opt3 from neuraminidase__InfluenzaA__AJJ98851

SEQ ID NO: 147897 - RNA, 1410 nt, Artificial Sequence
  derived and/or modified sequence opt3 from neuraminidase__InfluenzaA__AJJ98863
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaacguacacccuauagaacucuccugaugaaugagcuuggaguuccuuuucaccugggcaccaaacaggugugcauugcuuggagcaguuccucuugucaugaugguaaggccugguugcacgucugcaucacaggggacgauaagaacgcaaccgccagcuucaucuacaauggaaggcucguggacuccguaguuucauggaguaaagaaauucugcggacgcaggagagcgaguguauaugcaucaacggcacuuguacaguggucaugaccgauggcucugcuuccgggaaggcagacacuaaaauucuguuuaucgaagagggaaagauagugcauacaucaacccucagcgguagugcccaacacguggaagagugcucuugcuauccacgcuacccgggcgucagauguguuugcagggauaacuggaagggguccaaucggcccauuguggacaucaacaugaaagaucacagcaucguaucgucuuacguguguuccggauuagucggcgacacgccucgcaagaaugacucaaguagcuccucucauugccuggauccaaacaaugaagagggugggcacggagugaaaggcugggcuuucgacgauggcaacgacguuuggauggggcgaaccauuagcgagaagucaagacuuggauaugaaacauuuaaagugaucgaggguuggaguaaucccaaguccaaauugcagauuaacaggcaggucauaguggaucggggcaaucguagcggguacucuggaaucuucucaguagaaggcaagaguuguauuaaccgcugcuuuuauguugagcugaucagagguaggaaggaagagacugaggugcuauggaccagcaauuccaucgucguguucugugggacaucuggcacuuacggaaccggcucguggccugacggggccgauauuaaccucaugccaauauga

SEQ ID NO: 147898 - RNA, 1410 nt, Artificial Sequence
  derived and/or modified sequence opt3 from neuraminidase__InfluenzaA__AJJ98875
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaaugauaccgugcgaaaccguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuagcgagaagucaagacuuggauaugagacauuuaaagucaucgaagguuggaguaaucccaaguccaaauugcagauuaacaggcaagugauaguagaccggggcaaucguagcggguacucuggaaucuucucaguugagggcaagaguuguauuaaccgcugcuuuuauguggaacugaucagagguaggaaggaggaaacugagguccuauggaccagcaauuccaucguggucuucugugggacaucuggcacuuacggaaccggcucguggccugauggggccgacauuaaccucaugccaauauga

SEQ ID NO: 147899 - RNA, 1410 nt, Artificial Sequence
  derived and/or modified sequence opt3 from neuraminidase__InfluenzaA__AJJ98887
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaaaucguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaacggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaauuggaagggguccaaccggccgauuguggacaucaauaucaaagaucacagcauuguaucgucuuacguguguuccggacuggucggcgacacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugacgugcucuggaccagcaacuccauugucguguucugugggacaucuggcacuuacggaaccggcucguggcccgauggggccgacauaaaucugaugccuaucuga

SEQ ID NO: 147900 - RNA, 1410 nt, Artificial Sequence
  derived and/or modified sequence opt3 from neuraminidase__InfluenzaA__AJJ98899
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgaaaucguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaacggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaauuggaagggguccaaccggccgauaguggacauuaauaucaaagaucacagcaucguaucgucuuacguguguuccggacuggucggcgacacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggaucggggcaaccguagcggguacucuggaaucuucucaguagagggcaagaguuguauuaaucgcugcuuuuauguugaacuaaucagagguaggaaggaggaaaccgaggugcucuggacaagcaacuccaucgucguguucugugggacuucuggcaccuacggaacaggcucguggcccgacggggccgauauuaaucugaugccuauauga

SEQ ID NO: 147901 - RNA, 1410 nt, Artificial Sequence; identical to SEQ ID NO: 144162
  derived and/or modified sequence opt3 from neuraminidase__InfluenzaA__AJJ98911

SEQ ID NO: 147902 - RNA, 1410 nt, Artificial Sequence; identical to SEQ ID NO: 144938
  derived and/or modified sequence opt3 from neuraminidase__InfluenzaA__AJJ98923

SEQ ID NO: 147903 - RNA, 1410 nt, Artificial Sequence
  derived and/or modified sequence opt3 from neuraminidase__InfluenzaA__AJJ98935
augaaccccaaucagaagaucauuaccauaggcagcgugucccugacaaucucuacuauuugcuucuuuaugcagaucgccauucucaucacgaccgucacacuucacuucaaaagauacgaguuuaacucaccuccaaauaaccagguuaugcugugugaaccgacuauaaucgagaggaauauuaccgaaaucguguauuugacaaacaccacuauugagaaggaaaucugccccaaaccugcugaguaccggaauuggaguaagccacagugugggauaacaggauucgcacccuuuagcaaagacaacuccauucgcuuaucugccgguggcgauaucuggguaacccgagagccuuaugugucgugcgacccagauaaguguuaccaguucgcgcuggggcaaggaacgacucuaaauaacguccauucaaauaacaccgugcgugacagaacacccuauaggacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggccggcucguggacuccguaguuucauggaguaaagagauucugcgcacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccagcacgucgaggaaugcucuugcuauccaagauacccggggguuaggugugugugccgggauaacuggaagggauccaaucgccccauaguagacauuaacaucaaagaucacagcaucgugucgucuuacgucuguuccggcuuagugggugacacgccucgaaagaaugacucaaguagcuccucucauugccuggauccaaacaaugaggaagggggacacggcguuaaaggcugggcuuucgacgaugggaacgacguguggaugggaagaaccauuaaugagacaagcaggcuugguuaugagacuuuuaaggucaucgaaggcuggucaaaccccaaaaguaaguugcaaauuaaucggcaagugauaguagaucguggggaccgcuccggauacagcggcaucuucucuguugaggguaaaucauguauuaacagaugcuuuuauguggaacugaucagggggcggaaggaggaaaccgagguccuauggacaaguaauagcaucguggucuucuguggcacuuccggaaccuacggcacagggucuuggccugauggagccgaccucaaccugaugccaauuuga

SEQ ID NO: 147904 - RNA, 1410 nt, Artificial Sequence
  derived and/or modified sequence opt3 from neuraminidase__InfluenzaA__AJJ98947
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuacucugugugaaccgaccauaaucgagagaaauauuacagaaaucguguauuugaccaacacuacaauugagaaggaaaucugccccaaauuagcugaguacaggaauuggaguaagccucagugugacauaaccggguucgcaccauuuagcaaagauaacuccauucggcugucugccggaggugacaucuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcauugcuuggagcaguuccucuugucaugacgguaaggccuggcuccacgucugcaucaccgggaacgauaagaaugcaacggccagcuucaucuacaacggaaggcugguggacuccguaguuucauggaguaaagagauucugcggacucaggaaagcgagugugugugcauaaacggcacauguaccgucgugaugacugauggcucugcuuccgggaaggcagacacaaaaauccucuuuauugaggaaggaaagaucgugcauaccucaacguuaagcgguagugcccaacacgucgaggaaugcucuugcuauccucgcuacccaggcguuagaugugugugcagggauaauuggaagggguccaaccggccgauaguagacauuaauaucaaagaucacagcaucgugucgucuuacgucuguuccggacuggugggcgacacccccaggaagaacgacucaaguagcuccucucauugccuugauccuaauaacgaggaaggugggcacggaguuaaaggcugggcuuucgacgauggcaaugacguguggauggggcgaacaauuaacgagacuagcagauugggauaugagaccuuuaaggucaucgaagguuggucaaauccaaaaaguaagcugcagauuaaccgccaggugauaguagaucggggcaaucguuccggguacagcggaaucuucucuguugagggcaaaucauguauuaaccgcugcuuuuauguggaacuaaucagagguaggaaggaggaaacagagguccucuggaccaguaauagcaucguggucuucugugggacuuccggcacauacggaaccggcucuuggcccgacggggccgaucugaaccuuaugccuauuuga

SEQ ID NO: 147905 - RNA, 1410 nt, Artificial Sequence
  derived and/or modified sequence opt3 from neuraminidase__InfluenzaA__AJJ98971
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugccuauauga

SEQ ID NO: 147906 - RNA, 1410 nt, Artificial Sequence
  derived and/or modified sequence opt3 from neuraminidase__InfluenzaA__AJJ98995
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaucgugcgagaucguacccccuauagaacacuccugaugaaugaacuuggaguuccuuuucaccugggcacuaaacaggugugcauugcuuggagcaguuccucuugucaugacgguaaggccugguugcacgucugcaucaccggggaugacaagaacgcaacagccagcuucaucuacaauggaaggcucguggauuccguaguuucauggaguaaagagauucugcggacccaggaaagcgagugugugugcauaaacggcacguguacugucgugaugacagacggcucugcuuccgggaaggcagauaccaaaauccuguuuauugaggaaggaaagaucgugcauacuucaacacucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacaccccucgcaagaaugauucaaguagcuccucucauugccuggacccaaacaaugaggaaggugggcacggaguuaaaggcugggcuuucgaugacggcaacgauguguggauggggcgaacgauuaaugagaccagcagacuuggauaugagacauuuaaggucaucgaagguuggucaaaccccaaaaguaaguugcagauuaauaggcaagugauaguagaccgguccgaucguagcggcuacucugggaucuucucaguugagggaaaaaguuguauuaaccgcugcuuuuauguggaacugaucagaggcaggaaggaggaaacugagguccuauggaccagcaauuccaucguggucuucugugguacaucugggacuuacggcaccggaucguggccugacggcgccgaucucaaccugaugccaauuuga

SEQ ID NO: 147907 - RNA, 1410 nt, Artificial Sequence; identical to SEQ ID NO: 143159
  derived and/or modified sequence opt3 from neuraminidase__InfluenzaA__AJJ99007

SEQ ID NO: 147908 - RNA, 1410 nt, Artificial Sequence
  derived and/or modified sequence opt3 from neuraminidase__InfluenzaA__AJJ99019
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggaaagauugugcauaccucaacguuaagcgguagugcccaacacgucgaggaaugcucuuguuacccucgcuauccaggcguuagaugcguguguagggacaacuggaagggguccaaucggccgaucguagauauaaacauuaaagaccacagcaucgugucgaauuacgucugcucuggacuggugggcgacacccccaggaagaacgauuccucaaguagcucccauugucuugacccuaauaacgaggaaggugggcacggaguuaaaggcugggcuuucgaugacggcaaugauguguggauggggcgaacaaucucugaaaagagcagauuuggauacgagacuuucaaagucauugaggguuggucaaacccaaagaguaaauugcagaucaaucgccaggugauuguagaccggggcaaccguuccggguauagcggaauauuuucuguugagggcaagucaugcaucaaucgcuguuucuacguggaacugauuagagguaggaaggaggaaaccgagguccuauggacaaguaacagcaucguggucuucugcgggacuuccggcaccuauggaacaggcucuuggcccgauggggccgacaucaaucucaugccuauuuga

SEQ ID NO: 147909 - RNA, 1410 nt, Artificial Sequence
  derived and/or modified sequence opt3 from neuraminidase__InfluenzaA__AJJ99031
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacuauuaauaacguccauucaaaugauaccgugcgagaccguacaccauauagaacucuccugaugaacgaacuuggaguucccuuucaccugggcaccaaacaggugugcaucgcuuggagcaguuccucuugucaugaugguaaggccugguugcacgucugcaucacaggggacgauaagaaugcaaccgccagcuucauuuacaacggaaggcucguggacuccguaguuucauggaguaaagagauacugcggacgcaggaaagcgagugugugugcaucaauggcacuuguacagucgugaugaccgauggcucugcuuccgggaaggcagacacuaaaauucuguuuaucgaggaaggaaagauagugcauacaucaacccucagcgguagugcccaacacgucgaggaaugcucuugcuauccucgcuacccaggcguuagaugugugugcagggauaacuggaagggguccaaccggccgauuguagacaucaauaucaaagaccacagcauugugucgucuuacgucuguuccggauuagugggcgauacgccccgcaagaacgacucaaguagcuccucucauugccuggauccuaauaacgaggaaggugggcacggaguuaaaggcugggcuuucgacgauggcaaugacguguggauggggcgaaccaucagcgagaagucaagacuuggauaugagacauuuaaagucauugaagguuggaguaacccaaaguccaaauugcagauaaauaggcaagugaucguagaucggggcaaccguagcggguacucuggaauuuucucaguugagggcaagaguuguaucaaucgcugcuuuuauguggaacugaucagagguaggaaggaggaaacugagguccuauggaccagcaacuccauuguggucuucugugggacaucuggcacuuacggaaccggcucguggcccgacggggccgauauaaaucucaugccuaucuga

SEQ ID NO: 147910 - RNA, 1410 nt, Artificial Sequence
  derived and/or modified sequence opt3 from neuraminidase__InfluenzaA__AJJ99043
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggcggggguccaaccgcccgauaguagauauuaauaugaaagacuacagcaucgugucgucuuaugucuguuccggacuggugggcgacacgccccgaaagaacgauucaaguagcuccggucacugccuugacccuaauaacgaggaagggggacauggcguuaaaggcugggcuuucgaugacgggaaugauguguggaugggaagaaccaucucugaaaagagcaggucagguuacgagacauuuaaagucauugagggcuggaguaacccaaauuccaaguugcagaucaaccgucaggugauuguagaccgggggaaucgcagcggauauucuggcauauucucaguugaggguaaaaguuguaucaacagaugcuuuuacguggaacugauuagggggcggaaggaggaaacugagguccuauggaccagcaauuccaucguggucuucuguggcacaucuggaacuuauggcaccgggucguggcccgauggagccgacaucaaccucaugccuauuuga

SEQ ID NO: 147911 - RNA, 1410 nt, Artificial Sequence
  derived and/or modified sequence opt3 from neuraminidase__InfluenzaA__AJJ99067
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgaggccguacacccuauagaacucuccugaugaaugaacuugguguuccuuuucaccuggggaccaaacaggugugcauugcuuggagcaguuccucuugucaugacggaaaggccugguugcacgucugcaucacaggcgaugacaagaacgcaaccgccagcuucaucuacaauggcaggcucguggauuccguaguuucauggaguaaagacauucugcggacgcaggagagcgaaugugugugcauaaacgggacuuguacagucgugaugaccgauggaucugcuuccgguaaggcagacacuaaaauccuguuuauugaggagggcaagaucgugcauacaucaacccucagcgggagugcccaacacgucgaagagugcucuugcuauccacgcuacccgggaguuagaugugugugcagggauaacuggaagggcuccaaucggcccauaguagacauuaacaucaaagaucacagcaucgugucgucuuacgucuguuccgguuuagugggggacacgccucgcaagaaugacucaaguagcuccucucauugccuggauccaaacaaugaagagggaggccacggcguuaaagggugggcuuucgacgauggaaacgacguguggaugggucgaaccauuaaugaaacaagcagacuuggcuaugagacuuuuaaggucaucgagggguggucaaaccccaaaaguaaguugcagauuaauaggcaagugauaguagaucggggagaccguuccggcuacagcgguaucuucucuguugaagggaaaucauguauuaaccgcugcuuuuauguggagcugaucagaggcaggaaggaagagaccgaaguccuauggacaaguaauagcaucguggucuucuguggaacuuccggcaccuacgggacaggaucuuggccugauggugccgaccucaaccugaugccaauuuga

SEQ ID NO: 147912 - RNA, 1410 nt, Artificial Sequence
  derived and/or modified sequence opt3 from neuraminidase__InfluenzaA__AJJ99079
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgaaaucguacacccuauagaacucuccugaugaacgaacuuggcguuccuuuucaccuggguaccaaacaggugugcauugcuuggagcaguuccucuugucaugacgggaaggccugguugcacgucugcaucacaggagaugacaagaaugcaaccgccagcuucaucuacaacggcaggcucguggauuccguaguuucauggaguaaagagauucugcggacgcaggaaagcgagugugugugcauaaacggcacuuguacagucgugaugaccgacgggucugcuuccggaaaggcagauacuaaaauccuguuuauugaggaagguaagaucgugcauacaucaacccucagcggcagugcccaacacgucgaggaaugcucuugcuauccacgcuacccggggguuagaugugugugcagggacaauuggaagggauccaaccggcccauaguagauauuaauaucaaagaccacagcaucgugucgucuuacgucuguuccggcuuagugggugauacgccucgcaagaacgacucaaguagcuccucucauugccuggacccaaauaacgaggaagggggacacggcguuaaaggcugggcuuucgaugacgggaaugauguguggaugggacgaaccauuaacgagacaagcagacuugguuaugagacuuuuaaggucaucgaaggcuggucaaaucccaaaaguaaguugcagauuaacaggcaagugauaguagaccguggggaucgguccggauacagcggcaucuucucuguugaggguaaaucauguauuaaucgcugcuuuuauguggaacugaucagagggaggaaggaggaaaccgagguccuauggacaaguaacagcaucguggucuucuguggcacuuccggaaccuacggcacagggucuuggccugacggagccgaucucaaucugaugccaauuuga

SEQ ID NO: 147913 - RNA, 1410 nt, Artificial Sequence
  derived and/or modified sequence opt3 from neuraminidase__InfluenzaA__AJJ99091
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagagauucugcggacgcaggaaagcgagugugugugcauaaacggcacuuguacagucgugaugaccgaugggucugcuuccggaaaggcagacacuaaaauccuguuuauugaggaagguaagaucgugcauacaucaacccucagcggcagugcccaacacgucgaggaaugcucuugcuauccacgcuacccggggguuagaugugugugcagggauaacuggaagggauccaaucggcccauaguagacauuaacaucaaagaucacagcaucgugucgucuuacgucuguuccggcuuagugggugacacgccucgcaagaaugacucaaguagcuccucucauugccuggauccaaacaaugaggaagggggacacggcguuaaaggcugggcuuucgacgaugggaacgaccuuuggaugggacgaaccauuaaugagacaagcagauuggguuaugagacuuuuaaggugaucgaaggcuggucaaaccccaaaaguaagcugcagauuaauaggcaggucauaguggaucguggggaccgguccggauacagcggcaucuucucuguagaggguaaaucauguauuaaccgcugcuuuuauguugaacuaaucagagggaggaaggaggaaaccgaggugcucuggacaaguaauagcaucgucguguucuguggcacuuccggaaccuacggcacagggucuuggccugauggagccgaccugaaccuuaugccaauuuga

SEQ ID NO: 147914 - RNA, 1410 nt, Artificial Sequence
  derived and/or modified sequence opt3 from neuraminidase__InfluenzaA__AJJ99103
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauaugaccgaaauuguguauuugacaaacaccacuaucgagaaggaaauuugccccaaaccugcugaguacaggaauuggaguaagccacagugugacaucacaggguucgcacccuuuagcaaagauaacuccauacgguuaucugccggaggugacauuuggguaacccgcgagccuuaugugucgugcgauccagacaaguguuaccaauucgcgcugggccaggggacgacucuaaauaacguccauucaaauaacaccgugcgaaaucguacacccuauagaacucuccugaugaacgaacuuggaguuccuuuucaccugggcaccaaacaggugugcaucgcuuggagcaguuccucuugucaugaugguaaggccugguugcacgucugcauuacaggggacgauaagaaugcaaccgccagcuucaucuacaacggaaggcucguggacuccguaguuucauggaguaaagagauccugcggacgcaggaaagcgagugugugugcauuaacggcacuuguacagucgugaugaccgauggcucugcuuccgggaaggcagacacuaaaauacuguuuaucgaggaaggaaagauugugcauacaucaacccucagcgguagugcccaacacgucgaggaaugcucuugcuauccacgcuacccgggcguuagaugugugugcagggauaauuggaagggguccaaccggcccaucguagacauaaauauuaaagaucacagcaucgugucgucuuacgucuguuccggauuagugggcgacacgccucgcaagaacgacucaaguagcuccucucauugccuggauccaaauaacgaggaaggugggcacggaguuaaaggcugggcuuucgacgauggcaaugacguguggauggggcgaaccaucaacgagacaagcagacuuggauaugagacuuuuaaggucauugaagguuggucaaaucccaaaaguaaguugcagaucaacaggcaagugauuguagaucgguccgaccguagcggcuacucugggauauucucaguugagggaaaaaguuguaucaaucgcugcuuuuauguggaacugauuagaggcaggaaggaggaaaccgagguccuauggacaagcaacuccaucguggucuucugugguacuucugggaccuacggcacaggaucguggccugauggcgccgaccucaaucugaugccaaucuga

SEQ ID NO: 147915 - RNA, 1410 nt, Artificial Sequence; identical to SEQ ID NO: 147381
  derived and/or modified sequence opt3 from neuraminidase__InfluenzaA__AJJ99115

SEQ ID NO: 147916 - RNA, 1410 nt, Artificial Sequence; identical to SEQ ID NO: 146301
  derived and/or modified sequence opt3 from neuraminidase__InfluenzaA__AJJ99127

SEQ ID NO: 147917 - RNA, 1410 nt, Artificial Sequence; identical to SEQ ID NO: 147589
  derived and/or modified sequence opt3 from neuraminidase__InfluenzaA__AJJ99139

SEQ ID NO: 147918 - RNA, 1410 nt, Artificial Sequence
  derived and/or modified sequence opt3 from neuraminidase__InfluenzaA__AJJ99151
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaauaacaccgugcgagaucguacacccuauagaacucuccugaugaaugaacuuggaguuccuuuucaccugggcaccaaacaggugugcauugcuuggagcaguuccucuugucaugacgguaaggccugguugcacgucugcaucacaggggaugacaagaacgcaaccgccagcuucaucuacaauggaaggcucguggauuccguaguuucauggaguaaagagauucugcggacgcaggaaagcgagugugugugcauaaacggcacuuguacagucgugaugaccgacggcucugcuuccgggaaggcagauacuaaaauccuguuuauugaggaaggaaagaucgugcauacaucaacccucagcgguagugcccaacacgucgaggaaugcucuugcuauccacgcuacccgggcguuagaugugugugcagggacaacuggaagggguccaaucggcccauaguagauauuaacaucaaagaccacagcaucgugucgucuuacgucuguuccggauuagugggcgacacgccucgcaagaaugauucaaguagcuccucucauugccuggacccaaacaaugaggaaggugggcacggaguuaaaggcugggcuuucgaugacggcaacgauguguggauggggcgaaccauuagcgagaagucaagacuuggauaugagacauuuaaagucaucgaagguuggaguaaucccaaguccaaauugcagauuaacaggcaagugauaguagaccggggcaaucguagcggguacucuggaaucuucucaguugagggcaagaguuguauuaaccgcugcuuuuauguggaacugaucagagguaggaaggaggaaacugagguccuauggaccagcaauuccaucguggucuucugugggacaucuggcacuuacggaaccggcucguggccugauggggccgacauuaaccucaugccaauauga

SEQ ID NO: 147919 - RNA, 1410 nt, Artificial Sequence; identical to SEQ ID NO: 138615
  derived and/or modified sequence opt3 from neuraminidase__InfluenzaA__AJJ99163

SEQ ID NO: 147920 - RNA, 1410 nt, Artificial Sequence
  derived and/or modified sequence opt3 from neuraminidase__InfluenzaA__AJJ99175
augaaccccaaucagaagaucauuaccauaggcagcgugucccugacaaucucuacuauuugccucuucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguuugcaccauucagcaaagauaacuccauucggcuaucugccggaggugacaucuggguaacccgcgagcccuaugugucgugcgauccugacaaguguuaccaauuugcgcucggccaggggacgacucugaauaacguccauucaaauaacaccgugcgagaucguacaccauauagaacucuucugaugaaugaauugggaguucccuuccaccucggcaccaaacaggugugcauugcuuggagcaguuccucuugucaugacgguaaggccuggcugcacgucugcaucacaggggaugacaagaacgcaaccgccagcuuuaucuacaauggaaggcugguggauuccguaguuucauggaguaaagagauucuccggacgcaggaaagcgagugugugugcauaaacggcacuuguacagucgugaugaccgacggcucugcuuccgggaaggcagauacuaaaaucuuauucauugaggaaggaaagaucgugcauacaucaacccugagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuugugggcgacacgccccgcaagaaugauucaaguagcuccucucauugcuuggacccuaacaaugaggaaggugggcacggaguuaaaggcugggcuuuugaugacggcaacgauguguggauggggcgaaccauuagcgagaagucaagacugggauaugagacauucaaagucaucgaagguuggaguaauccaaaguccaaacuacagauuaacaggcaagugauaguagaccggggcaaucguagcggguacucuggaaucuuuucaguugagggcaagaguuguauuaaccgcugcuucuauguggaacucaucagagguaggaaggaggaaacugagguccuguggaccagcaauuccaucguggucuuuugugggacaucuggcacuuacggaaccggcucguggcccgaugggacagacauuaaccuuaugccuauauga

SEQ ID NO: 147921 - RNA, 1410 nt, Artificial Sequence
  derived and/or modified sequence opt3 from neuraminidase__InfluenzaA__AJJ99199
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagagggcaagaguuguaucaaccgcugcuuuuauguugaacuaaucagagguaggaaggaggaaacugaggugcucuggaccagcaauuccauugucguguucugugggacaucuggcacuuacggaaccggcucguggcccgauggggccgacauaaaccugaugccuaucuga

SEQ ID NO: 147922 - RNA, 1410 nt, Artificial Sequence; identical to SEQ ID NO: 138759
  derived and/or modified sequence opt3 from neuraminidase__InfluenzaA__AJJ99211

SEQ ID NO: 147923 - RNA, 1410 nt, Artificial Sequence
  derived and/or modified sequence opt3 from neuraminidase__InfluenzaA__AJJ99223
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccggggaggcagauacuaagauucucuuuaucgaagagggaaaaauagugcauacaucaaccuuaagcgguagugcccaacacguggaagagugcucuugcuauccucgcuacccaggcgucagauguguuugcagggacaacuggaagggguccaaucggccgauuguggauaucaacaucaaggaccacagcauuguaucgucuuacguguguuccggacuggucggcgacacgccccgcaaaaaugauucaaguagcuccucucauugccuugacccuaacaaugaagagggugggcacggagugaagggcugggcuuucgaugacggcaacgauguuuggguggggcgaaccaucagcgagaaaucaagauugggauaugaaacauuuaaggucauugaggguuggaguaauccaaaauccaagcugcagauaaacaggcaagugaucguagaccggggcaaucguagcggguacucuggaauuuucucaguugaaggcaaaaguuguaucaaccgcugcuuuuauguggagcuaaucagagguaggaaggaagagacugagguccucuggaccagcaauuccauuguggucuucugugggacaucuggcacuuacggaaccggcucguggcccgauggggccgacauaaaccugaugccuaucuga

SEQ ID NO: 147924 - RNA, 1410 nt, Artificial Sequence
  derived and/or modified sequence opt3 from neuraminidase__InfluenzaA__AJJ99235
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaaugauaccgugcgagaccguacacccuauagaacucuccugaugaacgaacuuggaguuccuuuucaccugggcaccaaacaggugugcauugcuuggagcaguuccucuugucaugaugguaaggccugguugcacgucugcaucacaggggacgauaagaaugcaaccgccagcuucaucuacaacggaaggcucguggacuccauuguaucauggaguaaagagauacugcggacgcaggaaagcgaguguguuugcaucaauggcacuuguacaguggucaugaccgauggcucugcuuccggggaggcagacacuaagauucuguuuaucgaagagggaaaaauagugcauacaucaacccucagcgguagugcccaacacguggaagagugcucuugcuauccacgcuacccgggcgucagauguguuugcagggauaacuggaagggguccaaccggcccauuguggacaucaauaucaaggaccacagcauuguaucgucuuacguguguuccggauuagucggcgauacgccucgcaaaaacgacucaaguagcuccucucauugccuggauccaaauaacgaagagggugggcacggagugaagggcugggcuuucgacgauggcaaugacguuuggauggggcgaaccaucagcgagaaaucaagacuuggauaugaaacauuuaaggugauugaggguuggaguaaccccaaauccaaguugcagauaaauaggcaggucaucguggaucggggcaaccguagcggguacucuggaauuuucucaguagaaggcaaaaguuguaucaaucgcugcuuuuauguugagcugaucagagguaggaaggaagagacugaggugcuauggaccagcaacuccauugucguguucugugggacaucuggcacuuacggaaccggcucguggccugacggggccgauauaaaucucaugccaaucuga

SEQ ID NO: 147925 - RNA, 1410 nt, Artificial Sequence
  derived and/or modified sequence opt3 from neuraminidase__InfluenzaA__AJJ99246
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaaacgucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauuccggugcuguugcagugcugaaguauaacggcauuaucaccgacacgauaaagagcuggagaaauaacauuuugaggacucaagagucggagugugccugccucaaugggucuuguuucaccaucaugacagauggaccauccgacggccaggcuucauacaaaaucuuucggauugaaaaggguaaaaucgucaagaguguggagaugaacgcccccaauuaucauuacgaagagugcagcuguuacccugauuccucugagauuacuugcgugugccgcgacaacuggcacgggagcaauagaccaugggucucauucaaccagaaucuggaauaucagauaggauacaucuguaguggcauuuuuggcgauaacccgaggcccaaugacaaaaccggguccugcggaccuguuucgucuucaggugcgaacggcgugaagggguucaguuuuaaguauggaaauggcguauggaucggucggacaaaaagcaucuccucucgcaagggguucgagaugauuugggauccaaacggcuggaccggaacggacaacaauuuuucgauaaaacaagacaucgugggcauuaacgaauggagcggguacuccggaucauucguccagcaucccgagcugacuggucucgauuguauccgaccuugcuucuggguggaauuaauuagaggcaggccaaaggagaauacaaucuggaccagugggucuagcauauccuuuuguggaguuaacucagacacugugggcuggagcuggcccgauggugcagagcugccguucacaaucgacaaauga

SEQ ID NO: 147926 - RNA, 1410 nt, Artificial Sequence
  derived and/or modified sequence opt3 from neuraminidase__InfluenzaA__AJJ99257
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuccauccaauggugcgaacggcgugaagggguucagcuuuaaguauggaaacggcguauggaucggucggacaaaaucuauuucaagucgcaagggguucgagaugauaugggaucccaauggcuggaccggaacggacaacagcuuuuccaucaaacaagacauugugggcacuaaugaauggucuggguacucggggagcuucguccagcauccugagcugacaggucuggauuguauccgaccaugcuucuggguggaacucauuagaggcaggcccaaggagaacaccaucuggacuuccgggucaaguauaucuuuuuguggaguuaauagcggcacaguggguugguccuggccggacggggcagaguuaccuuucaccaucgauaaauga

SEQ ID NO: 147927 - RNA, 1413 nt, Artificial Sequence; identical to SEQ ID NO: 138648
  derived and/or modified sequence opt3 from neuraminidase__InfluenzaA__AJJ99269

SEQ ID NO: 147928 - RNA, 1410 nt, Artificial Sequence; identical to SEQ ID NO: 142974
  derived and/or modified sequence opt3 from neuraminidase__InfluenzaA__AJJ99280

SEQ ID NO: 147929 - RNA, 1410 nt, Artificial Sequence; identical to SEQ ID NO: 142725
  derived and/or modified sequence opt3 from neuraminidase__InfluenzaA__AJJ99291

SEQ ID NO: 147930 - RNA, 1413 nt, Artificial Sequence
  derived and/or modified sequence opt3 from neuraminidase__InfluenzaA__AJJ99303
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauggagcucaacgcaccuaauuuucauuaugaagaguguagcugcuacccagacaccggcauaguuaugugugugugcagggauaacuggcacggcuccaaucggcccugggucucuuucaaccagaaucuggacuaccaaaucggguauauuugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugaucugggaccccaauggcuggacaaacaccgauagcgacuucucuguaaaacaggauguggucgcuauuacugacuggucaggguacagugguagcuuugugcagcacccugaacucacaggauuagauugcauacgcccauguuucuggguugagcuggugcgaggccuucccagagaaaacaccacgaucuggaccuccgggucuucgauuagcuucugcggagucaauuccgacacagccaacuggucauggccugauggcgcagaguugccauuuacuaucgacaaguga

SEQ ID NO: 147931 - RNA, 1410 nt, Artificial Sequence
  derived and/or modified sequence opt3 from neuraminidase__InfluenzaA__AJJ99314
augaaccccaaucagaagaucauuaccauaggcagcgccugcaugacaaucgggauggcuaaccugauucuccaaaucggaaauauuaucuccauauggaucucucacucaauucagcuugguaaccagaaucagaucgagacuuguaaccaaagugugauuacguacgaaaauaacaccugggucaaucagacauauguuaacaucagcaauacuaacuucgcagccggccaguccgugguaucugugaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 147932 - RNA, 1413 nt, Artificial Sequence
  derived and/or modified sequence opt3 from neuraminidase__InfluenzaA__AJJ99326
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggcuuggauggcugacgauugguaucuccggcccagacaacggggccguggcugucuugaaguauaauggaauaauuacuggcaccaucaaaagcuggaagaaacagauccucagaacacaggagucggagugcguguguaugaacgguucuugcuuuacuauuaugaccgaugggcccuccaauaaggccgcgucauacaaaaucuucaagauugaaaagggaaaaguaacaaagaguauagagcugaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcuccggaagggcuuugagaugauuugggaccccaauggguggacaaacaccgacagcgauuucucuguaaaacaggacguggucgcuauaacugauuggucaggauauagugguagcuuugugcagcacccugaauuaacaggccuggacugcauccgcccauguuucuggguugagcuugugcgaggguugcccagagaaaacaccacgauuuggaccuccggaucuucgaucagcuucugcggcgucaauuccgauacagccaacuggucauggccugacggugcagagcugccauuuacuauugauaaguga

SEQ ID NO: 147933 - RNA, 1410 nt, Artificial Sequence; identical to SEQ ID NO: 140398
  derived and/or modified sequence opt3 from neuraminidase__InfluenzaA__AJJ99337

SEQ ID NO: 147934 - RNA, 1410 nt, Artificial Sequence; identical to SEQ ID NO: 139861
  derived and/or modified sequence opt3 from neuraminidase__InfluenzaA__AJJ99348

SEQ ID NO: 147935 - RNA, 1410 nt, Artificial Sequence; identical to SEQ ID NO: 138754
  derived and/or modified sequence opt3 from neuraminidase__InfluenzaA__AJJ99359

SEQ ID NO: 147936 - RNA, 1410 nt, Artificial Sequence
  derived and/or modified sequence opt3 from neuraminidase__InfluenzaA__AJJ99370
augaaccccaaucagaagaucauuaccauaggcagcgugugcaugaucauugggauggccaaccugauccuccaaauuggaaauaucauauccaucuggauuucucacucaauccagcuugguaaccagagucagauugagacauguaaucaaagcgucaucacuuacgaaaacaauacguggguuaaccagaccuaugugaauauauccaacacaaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacucagggggcucuacucaacgacaagcauaguaauggaacaauuaaagaucgcagcccccaccgaacccugaugucuuguccuauaggcgaggucccaucccccuauaacucacguuuugaaagcguggccuggagugcaucugccugccaugacggcaucaacuggcuuacuauugggaucuccggaccugauaauggugcuguagcaguucugaaguacaacggcauaauuacagacaccaucaagagcuggagaaauaacaucuugaggacgcaagagucggagugugccugcgugaaugggucuuguuucacuauuaugaccgauggaccauccgaccggcaggcuucauauaaaaucuuucgcauugaaaagggcaaaauagucaagaguguggagaugaacgcccccaauuaccacuaugaagagugcagcuguuacccugauuccucugagaucacaugcgugugcagagacaacuggcaugguagcaauaggccaugggucucauucaaccagaaucucgaauaccagauuggguauaucuguaguggaaucuuuggcgauaacccgcggcccaaugacaaaacuggcuccugcgggccuguuagcucuaacggagcgaauggugugaagggcuucucauuuaaguacgggaacggaguauggauuggccgcaccaaaaguauaagcucccgaaaggguuucgagaugaucugggauccaaacggguggacaggcaccgacaauaacuuuucuauuaaacaagacaucgugggaauuaaugaauggucgggcuauagcggguccuucguccagcaccccgagcugacgggacuggauuguaucagaccuugcuucuggguggaacucauaaggggucggccaaaggagaacacuaucuggacaucaggcaguucuauuagcuuuugugggguuaauuccgacaccgugggauggucauggcccgauggcgcagaguuaccguucacuaucgacaaauga

SEQ ID NO: 147937 - RNA, 1410 nt, Artificial Sequence; identical to SEQ ID NO: 142273
  derived and/or modified sequence opt3 from neuraminidase__InfluenzaA__AJJ99381

SEQ ID NO: 147938 - RNA, 1410 nt, Artificial Sequence
  derived and/or modified sequence opt3 from neuraminidase__InfluenzaA__AJJ99392
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccccaaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcaaaguuaccuuucacaaucgacaaauga

SEQ ID NO: 147939 - RNA, 1410 nt, Artificial Sequence; identical to SEQ ID NO: 138754
  derived and/or modified sequence opt3 from neuraminidase__InfluenzaA__AJJ99403

SEQ ID NO: 147940 - RNA, 1413 nt, Artificial Sequence; identical to SEQ ID NO: 139477
  derived and/or modified sequence opt3 from neuraminidase__InfluenzaA__AJJ99415

SEQ ID NO: 147941 - RNA, 1413 nt, Artificial Sequence
  derived and/or modified sequence opt3 from neuraminidase__InfluenzaA__AJJ99427
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgguguacaccaaggauaauucuaucaggaucgguagcaaaggggacgucuucgugauucgggagccuuuuauauccugcucacacuuggaaugucgcacuuucuuuuuaacacaaggagcucugcuaaacgauaagcauaguaauggcaccguuaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauuuccggcccagacaacggggccgucgcugugcugaaguauaauggaaucauaacuggcaccauuaaaagcuggaagaaacagaucuugagaacacaggagucggagugcguauguaugaacgguucuugcuuuacuaucaugaccgaugggcccuccgacaaggccgcgucauacaaaauuuucaagaucgaaaagggaaaaguuacaaagaguauugagcucaaugcaccuaacuuuuauuacgaagaguguagcugcuacccagauaccggcauagugaugugugucugcagggacaauuggcauggcuccaaccggcccugggugucuuucaaucagaaccuggauuaucaaaucggguacauuugcagcggaguguuuggugacaauccucgcccagaggauggcgaagggucauguaacccggucacgguugacggagccaauggcgugaaagguuucaguuauaaguacgggaacggcguauggaucggaagaacuaaauccaauaggcugcggaagggcuuugagaugaucugggaccccaacggguggauuaauacagauagcgacuucucugugaaacaggaugucguggcuauaaccgacuggucaggauauagugguagcuuuguucagcacccugaacucacuggcuuagauugcauccgcccauguuucuggguggagcugguccgagggcuucccagagaaaacacaaccauuuggacguccggaucuucgaucagcuucugcggcgugaacuccgacaccgccaauuggucauggccugauggugcagaguugccauuuacaauugacaaguga

SEQ ID NO: 147942 - RNA, 1413 nt, Artificial Sequence
  derived and/or modified sequence opt3 from neuraminidase__InfluenzaA__AJJ99439
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguaccuccggcugggcgauuuacacuaaggauaauucuaucaggaucgguagcaaaggggacguguucgucauucgggagccuuuuauauccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuaucgguauuuccggcccagacaacggggccguggcuguccugaaguauaauggaaucauaaccggcacaauuaaaagcuggaagaaacagaucuugagaacucaggagucggagugcguguguaugaacgguucuugcuuuaccaucaugacagaugggcccuccaauaaggccgcgucauacaaaauuuucaagaucgaaaagggaaaaguaaccaagaguauugagcucaacgcaccuaauuuuuauuacgaagaguguagcugcuacccagacacgggcauaguuaugugugugugcagggauaacuggcauggcuccaaucggcccugggucucuuucaaccagaaucuggacuaucaaaucggguacauuugcagcggaguguuuggugauaacccucgcccagaggacggcgaagggucauguaauccggugacugucgauggagccaacggcguuaaagguuucaguuauaaguacgggaauggcguguggaucggaagaacaaaauccaacaggcugcggaagggcuuugagaugaucugggaccccaauggguggaccaacacugacagcgauuucucuguaaaacaggacguggucgcuauuacagauuggucaggauauagugguagcuuugugcagcacccugaacucaccggcuuagacugcauacgcccauguuucuggguugagcuggugcgagggcuucccagagaaaacacgaccaucuggacauccggaucuucgauuagcuucugcggcgucaauuccgauacugccaacuggucauggccugacggugcagaguugccauuuaccaucgauaaguga

SEQ ID NO: 147943 - RNA, 1413 nt, Artificial Sequence
  derived and/or modified sequence opt3 from neuraminidase__InfluenzaA__AJJ99451
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaaucgaaccgugaaagaccguagcccauauagagcccucaugucuugcccgcugggcgaggcacccuccccuuacaacucaaaguucgaaagcguugccuggagugcuucugcaugucacgauggcaugggguggcuuacgauuggaaucuccgguccagacaacggcgccguggcuguccugaaguauaaugggauaauuacuggaaccaucaaaagcuggaagaaacagaucuugaggacacaggagucggagugcguguguaugaacggcucuugcuuuacuauuaugaccgauggucccuccaauaaggccgcgucauacaaaaucuucaagauugaaaaggggaaaguaacaaagaguauagagcucaacgcaccuaauuuucauuaugaagaguguagcugcuacccagacaccggaaucguuaugugugugugccgggauaacuggcacggcuccaaucgccccugggucucuuucaaccagaaucuggacuaccaaauuggcuauaucugcagcgggguguuuggagauaacccuagaccagaggacggugaaggcucauguaauccggugacggucgauggggccaacggaguuaaaggcuucaguuacaaguaugacaaugguguguggaucgggaggacuaaauccaaccggcugcgcaagggcuuugagaugauuugggaccccaauggauggacaaacaccgauagcgacuucucuguaaaacaggauguggucgcuauaacugacuggucaggcuacagugggagcuuugugcagcacccugaacucacaggauuagauugcauccgaccauguuucuggguugagcuggugagaggucuucccagggaaaacaccacgauuuggaccuccgggucuucgaucagcuucugcggcgucaauuccgacacagccaacuggucauggccugauggagcagaguugccauuuacuauugacaaguga

SEQ ID NO: 147944 - RNA, 1413 nt, Artificial Sequence; identical to SEQ ID NO: 138648
  derived and/or modified sequence opt3 from neuraminidase__InfluenzaA__AJJ99463

SEQ ID NO: 147945 - RNA, 1410 nt, Artificial Sequence
  derived and/or modified sequence opt3 from neuraminidase__InfluenzaA__AJJ99474
augaaccccaaucagaagaucauuaccauaggcagcgugugcaugacaaucgggauugccaaccugauccuccaaauuggaaauaucauauccaucuggauuucucacucaauccagcuugguaaccagaaucagauugagacuuguaaccaaagugucaucauauacgaaaauaacacguggguuaaucagaccuaugugaacauuagcaauacaaacuucgcugcaggccaguccguagugucugucaaacuggccggaaauucgucauugugcccugugagcgggugggcgaucuacaguaaggacaacuccauuagaaucggcucuaaaggugauguuuuugugaucagggagccauucauuagcuguuccccguuagaaugccggaccuuuuuccugacucagggggcucuacucaaugacaagcauucaaacggaacaauaaaagaucgcagucccuaucgaacccugaugagcuguccuaucggcgaggucccaucucccuacaacucccguuuugaaucaguggccuggagcgcaagugccugccacgacggcauuaauuggcuuacuaucgggauaucuggaccugauaacggugcuguagcaguucugaaguauaauggcauuaucacagacaccaucaaguccuggagaaacaauauuuugaggacgcaagagagcgagugugccugcgugaacgggucguguuucacuaucaugaccgauggaccaucugacggccaggcuuccuacaaaauuuuucggauagaaaaggguaaaaucauuaagucagucgagaugaaugcccccaacuaucauuacgaagagugcaguuguuacccugauagcuccgagaucacaugcgugugccgcgacaauuggcacgggucuaacagaccaugggugagcuucaaucagaaccucgaauaucagaucggauacauuuguucaggcauauuuggcgauaauccgaggcccaacgacaaaacugggaguugcggaccugucuccagcaauggugcgaacggcguuaagggguucucuuuuaaguauggaaacggcguguggaucggucggaccaaaucaauuaguagccgcaagggguucgagaugaucugggauccaaauggcuggacaggaaccgacaacuccuuuucuauuaaacaagacaucguaggcauaaaugaauggucgggguacagcggauccuucgugcagcaucccgagcugacgggucuggauuguauccgaccuugcuucugggucgaacucauuagaggcaggccaaaggagaacacuaucuggacaucagggaguucuauuagcuuuuguggaguuaauuccggcaccguggguuggucauggcccgacggggcagaguuaccguucacuaucgauaaauga

SEQ ID NO: 147946 - RNA, 1410 nt, Artificial Sequence; identical to SEQ ID NO: 142725
  derived and/or modified sequence opt3 from neuraminidase__InfluenzaA__AJJ99496

SEQ ID NO: 147947 - RNA, 1410 nt, Artificial Sequence
  derived and/or modified sequence opt3 from neuraminidase__InfluenzaA__AJJ99507
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacggggcgaacagaccauggguuucuuucaaucagaaccucgaauaucagauaggauacaucuguagcggcauuuuuggcgauaauccgaggcccaacgacaaaaccgggucaugcggaccugugaguuccaauggugcaaacggcguaaagggguucagcuuuaaguaugauaacggaguguggaucggccggacaaaaucuaucucaagucgcaaugguuucgagaugauuugggacccaaacggguggaccggcacggacaaugauuuuagcauaaagcaagacaucgucggaauuaacgaaugguccggcuacucugggucguucgugcagcaucccgagcugacuggacuggauuguauccgaccuugcuucuggguugaacucauuagagguaggccaaaagagaauacaaucuggaccagcggcuccucaauaaguuuuuguggggugaacucugacacugucggauggagcuggcccgauggcgccgaguuaccguucacaaucgacaaguga

SEQ ID NO: 147948 - RNA, 1410 nt, Artificial Sequence; identical to SEQ ID NO: 138754
  derived and/or modified sequence opt3 from neuraminidase__InfluenzaA__AJJ99518

SEQ ID NO: 147949 - RNA, 1410 nt, Artificial Sequence
  derived and/or modified sequence opt3 from neuraminidase__InfluenzaA__AJJ99529
augaaccccaaucagaagaucauuaccauaggcagcgugugcaugacaaucgggauggccaaccugauucuccaagucggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccgggaauagcucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcuucaauuggcuuacaauugggauaucuggaccugauaacggugcuguugcagugcugaaguauaauggcaucauuaccgacacgaucaaguccuggagaaacaauauauugaggacucaagagagcgagugugccugcgucaacgggucguguuuuaccauuaugacagauggaccaucugacggccaggcuuccuacaaaaucuuccggaucgaaaaggguaaaauuaucaagucaguggagaugaaugcccccaacuaucauuacgaagagugcaguuguuacccugauagcuccgagauuacuugcgugugccgcgacaauuggcacgggucuaacagaccaugggucagcuuuaaucagaaccucgaauaucagauaggauacaucuguucaggcauuuucggcgauaauccgaggcccaacgacaaaaccgggaguugcggaccuguuuccagcaauggugcgaacggcgugaagggguuuucuuucaaguauggaaacggcguauggaucggucggacaaaaucaaucaguagccgcaagggguuugagaugauuugggauccaaauggcuggaccggaacggacaacuccuucucuauaaaacaagacaucgugggcauuaaugaauggucgggguacagcggauccuucguccagcaucccgagcugacuggucuggauuguauccgaccuugcuuuuggguggaacucauuagaggcaggccaaaggagaacacaaucuggaccucagggaguucuauaucguucuguggaguuaauuccggcacuguggguuggucauggcccgacggggcagaguuaccguuuacaaucgauaaauga

SEQ ID NO: 147950 - RNA, 1410 nt, Artificial Sequence
  derived and/or modified sequence opt3 from neuraminidase__InfluenzaA__AJJ99540
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccaaaauaacuugcgugugccgcgacaauuggcacgggucuaacagaccaugggucagcuucaaucagaaccucgaguaucagaucggauacauuuguucaggcaucuuuggcgauaauccgaggcccaacgacaagaccgggaguugcggaccuguuuccagcaauggugcgaacggcgugaagggguucucuuuuaaauauggaaacggcaucuggauuggucggacaaagucaauaaguagccgcaaaggguucgaaaugaucugggauccaaauggcuggaccggaacggacaacaauuuuuccauuaagcaagacaucguaggcauuaacgaguggucuggguacucggggagcuucgugcagcaucccgaacugacuggucuggauuguauccgaccuugcuucugggucgagcucauaagaggcaggccaaaagaaaauacaaucuggaccuccgggucaaguauuucuuuuuguggagugaacagcgacacuguuggcugguccuggcccgauggugcagaguuaccguucacaaucgacaaguga

SEQ ID NO: 147951 - RNA, 1410 nt, Artificial Sequence
  derived and/or modified sequence opt3 from neuraminidase__InfluenzaA__AJJ99551
augaaccccaaucagaagaucauuaccauaggcagcgugugcaugacaaucgggauggccaaccugauucuccaaaucggaaauauuaucuccauauggaucucucacucaauucagcuugguaaccagagucagacugagacguguaaucaaagcgucaucaccuacgaaaacaauacauggguuaaccagacuuaugugaauauuuccaacaccaauccugcugcaggccagucuguagugucggucaaacuggccgggaacaguagcuugugcccagugaguggaugggcgaucuacuccaaggacaauucuauaagaauuggcagcaaaggugauguuuucgugaucagggagccguuuauuuccuguucaaguuuagaaugccggacauucuuucugacccagggggcucuacucaacgacaagcauagcaauggaacuaucaaagaucgcucucccuaucgaacacugauguccuguccuaucggcgaggucccaucacccuacaacagccguuucgaaaguguggccuggucugcauccgccugccacgacggcauuaacuggcuuaccauagggaucagcggaccugauaauggugcuguagcaguucugaaguauaacggcauuaucacggacacuauaaagucguggagaaauaacauuuugaggacccaagagucugagugugccugcgugaauggguccuguuuuacaaucaugacugauggaccaucagacggccaggcuaguuacaaaaucuuccggauugaaaaggguaaaaucgucaagagcguggagaugaacgcccccaauuaucauuacgaagagugcuccuguuacccugauucuagcgagauuaccugcgugugccgcgacaacuggcacgggucaaauagaccaugggucaguuuuaaccagaaucucgaauaucagauaggauacaucuguuccggcauuuucggcgauaacccgaggcccaaugacaaaacagggagcugcggaccuguuucuucaaacggugcgaauggcgugaagggguuuaguuucaaguauggaaacggcguauggaucggucggaccaaaagcaucuccucucgcaagggguuugagaugauuugggauccaaacggcuggacgggaacugacaauaacuucucgauaaaacaagacaucgugggcauuaaugaauggagcggguacuccggaucauuuguccagcaucccgagcugacaggucuggauuguauccgaccuugcuucuggguggaacucauuagaggcaggccaaaggagaacaccaucuggacuucagggucuagcauauccuucuguggaguuaauucagacacagugggcuggagcuggcccgauggugcagaguuaccguuuaccaucgacaaauga

SEQ ID NO: 147952 - RNA, 1410 nt, Artificial Sequence; identical to SEQ ID NO: 142741
  derived and/or modified sequence opt3 from neuraminidase__InfluenzaA__AJJ99562

SEQ ID NO: 147953 - RNA, 1410 nt, Artificial Sequence
  derived and/or modified sequence opt3 from neuraminidase__InfluenzaA__AJJ99573
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaagggguucgagaugauaugggauccaaacggcuggaccggaacggacaauaacuuuucuaucaaacaagacguggucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 147954 - RNA, 1410 nt, Artificial Sequence; identical to SEQ ID NO: 147931
  derived and/or modified sequence opt3 from neuraminidase__InfluenzaA__AJJ99584

SEQ ID NO: 147955 - RNA, 1410 nt, Artificial Sequence
  derived and/or modified sequence opt3 from neuraminidase__InfluenzaA__AJJ99595
augaaccccaaucagaagaucauuaccauaggcagcgugugcaugacaaucgggauggccaaccugauuuuccaaaucggaaauauuaucuccauauggaucucucacucaauucagcucgguaaccagaaucagaucgagacuuguaaccaaagugucauuacguacgaaaauaacaccuggguuaaucagacauaugugaacaucagcaauacuaacuuugcugcaggccaguccguagugucugucaaacuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagagaacacaaucuggaccuccgggucaaguauaucuuucuguggagugaauagcgacacugucggcugguccuggcccgauggugcagagcucccguuuacaaucgacaaguga

SEQ ID NO: 147956 - RNA, 1410 nt, Artificial Sequence
  derived and/or modified sequence opt3 from neuraminidase__InfluenzaA__AJJ99606
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcgugaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 147957 - RNA, 1413 nt, Artificial Sequence; identical to SEQ ID NO: 139477
  derived and/or modified sequence opt3 from neuraminidase__InfluenzaA__AJJ99618

SEQ ID NO: 147958 - RNA, 1413 nt, Artificial Sequence
  derived and/or modified sequence opt3 from neuraminidase__InfluenzaA__AJJ99630
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuaugaaacagaacguaguggcuauaacugacuggucaggauauagugguagcuuuguccagcacccugaacucacaggcuuagauugcauccgcccauguuucuggguggagcugguucgagggcuucccagagaaaauaccacgauuuggaccuccggaucuucgaucagcuucugcggcgugaacuccgacacagccaauuggucauggccugauggugcagaguugccauuuacuauugacaaguga

SEQ ID NO: 147959 - RNA, 1413 nt, Artificial Sequence; identical to SEQ ID NO: 139477
  derived and/or modified sequence opt3 from neuraminidase__InfluenzaA__AJJ99642

SEQ ID NO: 147960 - RNA, 1413 nt, Artificial Sequence; identical to SEQ ID NO: 139477
  derived and/or modified sequence opt3 from neuraminidase__InfluenzaA__AJJ99654

SEQ ID NO: 147961 - RNA, 1413 nt, Artificial Sequence
  derived and/or modified sequence opt3 from neuraminidase__InfluenzaA__AJJ99666
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacaauaacguuguggcaggggaagacaaaacuucgguaacccuugccggaaauucaagccuguguaguauuuccggcugggcgaucuacacaaaggauaacucuaucaggauugguagcaaaggggacguguucgucauacgggagccuuuuaucuccugcucacacuuggaaugucgcaccuucuuuuuaacucaaggagcucugcuaaaugauaagcauaguaacggcacagugaaagaccgaagcccauaucgugcccucaugucuugcccgcugggcgaggcacccuccccuuacaacucaaaguucgaaagcguugccuggagugcuucugcaugucacgaugggaugggauggcuuaccauugguaucuccggcccagacaauggggccguggcuguccugaaguauaacggaauaauuacgggcacuaucaaaagcuggaagaaacagaucuugagaacccaggagucggagugcguguguaugaaugguucuugcuuuacaauuaugacugaugggcccuccaacaaggccgcgucauacaaaaucuucaagauugaaaagggaaaaguaaccaagaguauagagcucaaugcaccuaacuuucauuaugaagaguguagcugcuacccagacacaggcaucguuaugugugugugcagggauaauuggcacggcuccaaccggcccugggucucuuucaaucagaaccuggacuaccaaauuggguauaucugcagcggaguguuuggugauaauccucgcccagaggacggcgaagggucauguaacccggugaccgucgauggagccaauggcguuaaagguuucaguuacaaguaugacaacgggguguggaucggcagaacgaaauccaauaggcugcggaagggauuugagaugauuugggaccccaacggcuggacuaacacagauagcgacuucucuguaaaacaggauguggucgcuauaaccgacuggucaggguacagugguagcuuugugcagcacccugaacucacuggauuagauugcauccgcccauguuucuggguugagcuggugcgaggccuucccagagaaaauacaaccauuuggacguccgggucuucgaucagcuucugcggagucaacuccgacaccgccaauuggucauggccugauggcgcagaguugccauuuacaauugacaaguga

SEQ ID NO: 147962 - RNA, 1410 nt, Artificial Sequence
  derived and/or modified sequence opt3 from neuraminidase__InfluenzaA__AJJ99677
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauuauaaagucagucgagaugaaugcccccaacuaucauuacgaagagugcaguuguuacccugauagcuccgagaucacuugcgugugccgcgacaauuggcacgggucuaacagaccaugggugagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaagggguucgagaugaucugggauccaaauggcuggaccggaacggacaacuccuuuucuauuaaacaagacaucguaggcaugaaugaauggucgggguacagcggauccuucgugcagcaucccgagcugacuggucuggauuguauucgaccuugcuucugggucgaacucaucagaggcaggccaaaggagaacacaauauggaccucagggaguucuaucagcuuuuguggaguuaauuccggcacuguggguuggucauggcccgacggggcagaguuaccguucacaauugauaaauga

SEQ ID NO: 147963 - RNA, 1410 nt, Artificial Sequence
  derived and/or modified sequence opt3 from neuraminidase__InfluenzaA__AJJ99688
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauuauaaagucagucgagaugaaugcccccaacuaucauuacgaagagugcaguuguuacccugauagcuccgagaucacuugcgugugccgcgacaauuggcacgggucuaacagaccaugggugagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaagggguucgagaugaucugggauccaaauggcuggaccggaacggacaacuccuuuucuauuaaacaagacaucguaggcauuaaugaauggucgggguacagcggauccuucgugcagcaucccgagcugacuggucuggauuguauccgaccuugcuucugggucgaacucauaagaggcaggccaaaggagaacacaaucuggaccucagggaguucuauuagcuuuuguggaguuaauuccggcacuguggguuggucauggcccgacggggcagaguuaccguucacaaucgauaaauga

SEQ ID NO: 147964 - RNA, 1410 nt, Artificial Sequence
  derived and/or modified sequence opt3 from neuraminidase__InfluenzaA__AJJ99710
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucuaaaauaacuugcgugugccgcgacaacuggcacgggagcaauagaccaugggucucauucaaccagaaucucgaguaucagaucggauacauuuguaguggcaucuuuggcgauaacccgaggcccaaugacaagaccggguccugcggaccuguuagcucuaacggugcgaauggcgugaagggguucucauuuaaauauggaaacggcguauggaucggucggacaaagaguauuagcucccgcaaaggguucgaaaugauaugggauccaaacggcuggaccggaacggacaauaacuuuucuaucaagcaagacauugugggcaucaaugaguggucgggguacagcggauccuucguccagcaucccgaacugacuggucuggauuguauucgaccuugcuucuggguggagcucaucagaggcaggccaaaagaaaacacaauauggaccucagggaguucuaucagcuuuuguggaguuaauuccgacacugugggcuggucauggcccgauggugcagaguuaccguucacaauugacaaguga

SEQ ID NO: 147965 - RNA, 1410 nt, Artificial Sequence; identical to SEQ ID NO: 142273
  derived and/or modified sequence opt3 from neuraminidase__InfluenzaA__AJJ99721

SEQ ID NO: 147966 - RNA, 1410 nt, Artificial Sequence; identical to SEQ ID NO: 142273
  derived and/or modified sequence opt3 from neuraminidase__InfluenzaA__AJJ99732

SEQ ID NO: 147967 - RNA, 1410 nt, Artificial Sequence; identical to SEQ ID NO: 142973
  derived and/or modified sequence opt3 from neuraminidase__InfluenzaA__AJJ99743

SEQ ID NO: 147968 - RNA, 1410 nt, Artificial Sequence; identical to SEQ ID NO: 140307
  derived and/or modified sequence opt3 from neuraminidase__InfluenzaA__AJJ99754

SEQ ID NO: 147969 - RNA, 1410 nt, Artificial Sequence
  derived and/or modified sequence opt3 from neuraminidase__InfluenzaA__AJJ99765
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcuaccggccaguccguagugucugucaaacuggcaggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 147970 - RNA, 1413 nt, Artificial Sequence
  derived and/or modified sequence opt3 from neuraminidase__InfluenzaA__AJJ99777
augaaccccaaucagaagaucauuaccauaggcagcaucuccauugccaucgggauuaucucucugauacuccaaaucggaaacauuaucucaauuugggcuagucacagcauccagacagguucccagaauaacacuggcauaugcaaucagagaauuaucacguacgagaacucuaccugggugaaucauacauaugugaacauuaauaacacuaauguuguggcaggggaagacaaaaccucgguaacacuugccggaaacucaagccuguguaguaucuccggcugggcgaucuacaccaaggauaauucuauuaggauagguagcaaaggggacguguucgucauccgggagccuuuuauuuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgaucgguauauccggcccagacaacggggccguggcuguccugaaguauaauggaauuaucacuggcaccaucaaaagcuggaagaaacagauuuugagaacacaggagucggagugcguguguaugaacgguucuugcuuuacuaucaugaccgaugggcccuccaauaaggccgcgucauacaaaauuuucaagauagaaaagggaaaaguaacaaagaguaucgagcucaacgcaccuaauuuuuauuacgaagaguguagcugcuacccagacaccggcauuguuaugugugugugcagggauaacuggcauggcuccaaucggcccugggucucuuucaaccagaaucuggacuaucaaaucggguacaucugcagcggaguguuuggugauaacccucgcccagaggacggcgaagggucauguaauccggugacggucgauggagccaacggcguuaaagguuucaguuauaaguacgggaauggcguguggauuggaagaacuaaauccaacaggcugcggaagggcuuugagaugauaugggaccccaauggguggacaaacaccgacagcgauuucucuguaaaacaggacguggucgcuaucacugauuggucaggauauagugguagcuuugugcagcacccugaacucacaggcuuagacugcauucgcccauguuucuggguugagcuggugcgagggcuucccagagaaaacaccgccgucuggacguccggaucuucgaucagcuucugcggcgucaauuccgauaccgcaaacuggucauggccugacggugcugaguugccauuuacaauugauaaguga

SEQ ID NO: 147971 - RNA, 1410 nt, Artificial Sequence; identical to SEQ ID NO: 138754
  derived and/or modified sequence opt3 from neuraminidase__InfluenzaA__AJJ99788

SEQ ID NO: 147972 - RNA, 1413 nt, Artificial Sequence
  derived and/or modified sequence opt3 from neuraminidase__InfluenzaA__AJJ99800
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuauuaucgauaaguga

SEQ ID NO: 147973 - RNA, 1413 nt, Artificial Sequence; identical to SEQ ID NO: 139477
  derived and/or modified sequence opt3 from neuraminidase__InfluenzaA__AJJ99812

SEQ ID NO: 147974 - RNA, 1413 nt, Artificial Sequence
  derived and/or modified sequence opt3 from neuraminidase__InfluenzaA__AJJ99824
augaaccccaaucagaagaucauuaccauaggcagcaucuccauugccaucgggacaauuucucugaugcuccaaaucggaaacauaaucucaauuugggcuagucacagcauccagacugguucccagaauaacacgggcauuugcaaucagagaaucauaaccuacgagaacucuacaugggugaaucauacuuaugucaacauuaauaacaccaauguuguggcaggggaagacaaaacaucgguaacccuugccggaaacucaagccuguguaguaucuccggcugggcgauuuacacuaaggauaauucuaucaggaucgguagcaaaggggacguguucgucauucgggagccuuuuauauccugcucacacuuggaaugucgcacauucuuuuuaacccaaggagcucugcuaaacgauaagcauaguaauggcacggugaaagaccgaagcccauaucgugcccucaugucuugcccgcugggcgaggcacccuccccuuacaacucaaaguucgaaagcguugccuggagugcuucugcaugucacgaugggaugggauggcuuacuaucgguauuuccggcccagacaacggggccguggcuguccugaaguauaauggaaucauaaccggcacaauuaaaagcuggaagaaacagaucuugagaacucaggagucggagugcguguguaugaacgguucuugcuuuaccaucaugacagaugggcccuccaauaaggccgcgucauacaaaauuuucaagaucgaaaagggaaaaguaaccaagaguauugagcucaacgcaccuaauuuucauuaugaagaguguagcugcuacccagacacgggcauaguuaugugugugugcagggauaacuggcacggcuccaaucggcccugggucucuuucaaccagaaucuggacuaccaaaucggguauauuugcagcggaguguuuggugauaacccucgcccagaggacggcgaagggucauguaauccggugacugucgauggagccaacggcguuaaagguuucaguuacaaguaugacaaugggguguggaucggcagaacaaaauccaacaggcugcggaagggauuugagaugaucugggaccccaauggcuggaccaacacugauagcgacuucucuguaaaacaggauguggucgcuauuacagacuggucaggguacagugguagcuuugugcagcacccugaacucaccggauuagauugcauacgcccauguuucuggguugagcuggugcgaggccuucccagagaaaacacgaccaucuggacauccgggucuucgauuagcuucugcggagucaauuccgacacugccaacuggucauggccugauggcgcagaguugccauuuaccaucgacaaguga

SEQ ID NO: 147975 - RNA, 1410 nt, Artificial Sequence; identical to SEQ ID NO: 147963
  derived and/or modified sequence opt3 from neuraminidase__InfluenzaA__AJJ99835

SEQ ID NO: 147976 - RNA, 1410 nt, Artificial Sequence; identical to SEQ ID NO: 142273
  derived and/or modified sequence opt3 from neuraminidase__InfluenzaA__AJJ99846

SEQ ID NO: 147977 - RNA, 1410 nt, Artificial Sequence; identical to SEQ ID NO: 142273
  derived and/or modified sequence opt3 from neuraminidase__InfluenzaA__AJJ99857

SEQ ID NO: 147978 - RNA, 1410 nt, Artificial Sequence
  derived and/or modified sequence opt3 from neuraminidase__InfluenzaA__AJJ99868
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgucauuacuugcguuugccgcgacaauuggcacgggucuaacagaccaugggugagcuucaaucagaaccucgaguaucagauaggauacaucuguucaggcauuuuuggcgauaauccgaggcccaacgacaaaaccgggaguugcggaccuguauccagcaauggugcgaacggcgugaagggguucucuuuuaaguauggaaacggcgucuggaucggucggacaaaaucaaucaguagccgcaauggguucgaaaugauuugggauccaaacggcuggaccggaacggacaauaacuuuuccauaaagcaaaauaucgugggcauuaacgaguggucuggguacucggggagcuucguucagcaucccgaacugacuggucuggacuguauccgaccuugcuucuggguggagcucauuagaggcaggccaaaagaaaauacaaucuggaccuccgggucaaguauaucuuuuuguggagucaacagcgauacugugggcugguccuggcccgacggugcagaguuaccguucacaaucgauaaguga

SEQ ID NO: 147979 - RNA, 1410 nt, Artificial Sequence; identical to SEQ ID NO: 141173
  derived and/or modified sequence opt3 from neuraminidase__InfluenzaA__AJJ99879

SEQ ID NO: 147980 - RNA, 1410 nt, Artificial Sequence; identical to SEQ ID NO: 138754
  derived and/or modified sequence opt3 from neuraminidase__InfluenzaA__AJJ99890

SEQ ID NO: 147981 - RNA, 1410 nt, Artificial Sequence
  derived and/or modified sequence opt3 from neuraminidase__InfluenzaA__AJJ99901
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacuccuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguugacuccggcacuguggguuggucauggcccgauggggcagaguuaccguucacaauugacaaauga

SEQ ID NO: 147982 - RNA, 1410 nt, Artificial Sequence
  derived and/or modified sequence opt3 from neuraminidase__InfluenzaA__AJJ99912
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccaucaugacagauggaccauccgacggccaggcuucauacaaaauuuuucggaucgaaaaggguaaaauugucaagaguguggagaugaacgcccccaauuaucauuacgaagagugcagcuguuacccugauuccucuaaaauaacuugcgugugccgcgacaacuggcacgggagcaauagaccaugggucucauucaaccagaaucucgaguaucagaucggauacauuuguaguggcaucuuuggcgauaacccgaggcccaaggacaagaccggguccugcggaccuguuagcucuaauggugcgaacggcgugaaaggguucucauuuaaguauggaaauggcguauggaucggucggacaaaaaguauuagcucccgcaagggguucgaaaugauaugggauccaaacggcuggaccggaacggacaacaauuuuucuaucaaacaagacauugugggcaucaacgaguggucgggguacagcggauccuucguccagcaucccgaacugacuggucuggauuguauucgaccuugcuucuggguggagcucaucagaggcaggccaaaggaaaauacaauauggaccucagggaguucuaucagcuuuuguggaguuaacuccgacacugugggcuggucauggcccgauggugcagaguuaccguucacaauugacaaauga

SEQ ID NO: 147983 - RNA, 1410 nt, Artificial Sequence; identical to SEQ ID NO: 142273
  derived and/or modified sequence opt3 from neuraminidase__InfluenzaA__AJJ99923

SEQ ID NO: 147984 - RNA, 1410 nt, Artificial Sequence; identical to SEQ ID NO: 142725
  derived and/or modified sequence opt3 from neuraminidase__InfluenzaA__AJJ99934

SEQ ID NO: 147985 - RNA, 1410 nt, Artificial Sequence; identical to SEQ ID NO: 142273
  derived and/or modified sequence opt3 from neuraminidase__InfluenzaA__AJJ99945

SEQ ID NO: 147986 - RNA, 1410 nt, Artificial Sequence
  derived and/or modified sequence opt3 from neuraminidase__InfluenzaA__AJJ99956
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccugugcuguccaauggugcgaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 147987 - RNA, 1410 nt, Artificial Sequence; identical to SEQ ID NO: 138754
  derived and/or modified sequence opt3 from neuraminidase__InfluenzaA__AJJ99967

SEQ ID NO: 147988 - RNA, 1413 nt, Artificial Sequence
  derived and/or modified sequence opt3 from neuraminidase__InfluenzaA__AJJ99991
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacuguaccugggugaaucauacauaugucaacaucaauaacacuaauguuguggcaggggaagacaaaaccucuguaacacuugccggaaacucgucacugugcagcauuaguggcugggcgaucuacaccaaggauaauuccaucaggauugguucuaaaggggacguguucgucauacgggagccuuuuaucagcuguucccacuuggaaugccgcacuuucuuuuuaacacaaggagcucugcuaaacgauaagcauucaaauggcaccgugaaagaccgaaguccauaucgugcccucaugagcuguccgcugggcgaggcacccucuccuuacaacuccaaguucgaaucaguugccuggagcgcuagugcaugccacgaugggaugggauggcuuacgauugguaucucuggcccagacaacggggccguggcuguccugaaguauaauggaauaauuacuggcaccaucaaauccuggaagaaacagaucuugagaacacaggagagcgagugugugugcaugaacgguucguguuuuacuauuaugaccgaugggcccucuaauaaggccgcguccuacaaaaucuucaagauugaaaagggaaaaguaacaaagucaauagagcucaacgcaccuaauuuucauuaugaagagugcaguuguuacccagacaccggcaucguuaugugcgugugcagggauaacuggcacggcagcaaucggcccugggucuccuucaaccagaaucuggacuaccaaauuggguauaucuguucuggaguguuuggugauaacccucgcccagaggacggcgaagggagcugcaauccggugacggucgauggagccaacggcguuaaagguuucucauacaaguaugacaaugggguguggaucggcagaacuaaaaguaacaggcugcggaagggauuugagaugauuugggaccccaauggcuggacaaacaccgauuccgacuucagcguaaaacaggauguggucgcuauaacugacuggucuggguacucaggaaguuuugugcagcacccugaacucacagguuuagauuguauccgcccaugcuucuggguugagcuggugcgaggccuucccagagaaaacaccacgauuuggaccagcggguccucuaucucguucuguggagucaauagcgacacagccaacugguccuggccugauggcgcagaguugccauuuacuauugacaaguga

SEQ ID NO: 147989 - RNA, 1410 nt, Artificial Sequence; identical to SEQ ID NO: 147963
  derived and/or modified sequence opt3 from neuraminidase__InfluenzaA__AJK00003

SEQ ID NO: 147990 - RNA, 1410 nt, Artificial Sequence
  derived and/or modified sequence opt3 from neuraminidase__InfluenzaA__AJK00014
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcgugaucaccgacacgauaaagagcuggagaaauaacauuuugaggacucaagagucggagugugccugcgucaaugggucuuguuucaccaucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaagggguucgagaugauuugggauccaaacggcuggaccggaacggacaauaacuuuucuacuaaacaagacauagucggcaucaaugaauggucgggguacagcggauccuucgugcagcaucccgagcugacaggucuggauuguauucgaccuugcuucuggguugaacucaucagaggcaggccaaaggagaacaccauuuggacuucagggaguaucauaucuuuuuguggagugaauagcgacacagucggcugguccuggcccgauggugcagaguuaccguucaccaucgacaacuga

SEQ ID NO: 147991 - RNA, 1410 nt, Artificial Sequence
  derived and/or modified sequence opt3 from neuraminidase__InfluenzaA__AJK00025
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaagggguucgagaugauaugggauccaaauggcuggaccggaacggacaacuccuuuucuaucaaacaagacauugugggcaucaaugaauggucgggguacagcggauccuucguccagcaucccgagcugacuggucuggauuguauucgaccuugcuucuggguggaacucaucagaggcaggccaaaggagaacacaauauggaccucagggaguucuaucagcuuuuguggaguuaauuccggcacuguggguuggucauggcccgacggggcagaguuaccguucacaauugauaaauga

SEQ ID NO: 147992 - RNA, 1410 nt, Artificial Sequence
  derived and/or modified sequence opt3 from neuraminidase__InfluenzaA__AJK00036
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacauaaauuucgcugcaggccagucuguagugucggucaaacuggccgggaacagcucauugugcccugugaguggaugggcgauuuacuccaaggacaauucuaucagaauuggcagcaaaggugauguuuuugugaucagggagccauucaucuccuguucaccguuagaaugccggaccuuuuuccugacucagggggcucuacucaacgacaagcauaguaauggaacaauuaaagaucgcagccccuaucgaacccugaugucuuguccuauaggcgaggucccaucccccuacaacucacguuuugaaagcguggccuggagugcaucugccugccacgacggcaucaacuggcuuacuauugggaucuccggaccugauaauggugcuguagcaguucugaaguauaacggcauaauuacagacaccaucaagagcuggagaaauaacaucuugaggacgcaagagucggagugugccugcgugaaugggucuuguuucacuauuaugaccgauggaccauccgacggccaggcuucauacaaaaucuuucggauugaaaaggguaaaauagucaagaguguggagaugaacgcccccaauuaucauuacgaagagugcagcuguuacccugauuccucugagaucacaugcgugugccgcgacaacuggcacgggagcaauagaccaugggucucauucaaccagaaucucgaauaucagauuggauacaucuguaguggcaucuuuggcgauaacccgaggcccaaugacaaaacuggguccugcggaccuguuagcucuaacggugcgaauggcgugaagggguucucauuuaaguauggaaacggcguauggauuggucggaccaaaaguauaagcucccgcaagggguucgagaugaucugggauccaaacggcuggacaggaaccgacaauaacuuuucuauuaaacaagacaucgugggcauuaaugaauggucgggguacagcggauccuucguccagcaucccgagcugacgggucuggauuguauccgaccuugcuucuggguggaacucauaagaggcaggccaaaggagaacacuaucuggacaucagggaguucuauuagcuuuuguggaguuaauuccgacaccgugggcuggucauggcccgauggugcagaguuaccguucacuaucgacaaauga

SEQ ID NO: 147993 - RNA, 1410 nt, Artificial Sequence; identical to SEQ ID NO: 142973
  derived and/or modified sequence opt3 from neuraminidase__InfluenzaA__AJK00047

SEQ ID NO: 147994 - RNA, 1410 nt, Artificial Sequence; identical to SEQ ID NO: 142973
  derived and/or modified sequence opt3 from neuraminidase__InfluenzaA__AJK00058

SEQ ID NO: 147995 - RNA, 1410 nt, Artificial Sequence
  derived and/or modified sequence opt3 from neuraminidase__InfluenzaA__AJK00069
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauauuucaacaucagcaauacuaacuuugcugcaggccaguccgugguaucugugaaacuggccggaaauucgucauugugcccugucagcggaugggcgauauacaguaaggacaacuccauuagaaucggcucuaaaggugauguguucguuauuagggagccauuuaucagcuguuccccguuagaaugccggaccuucuuucugacacagggggcucuacucaaugacaagcauucaaacggaaccaucaaagaucgcagucccuaucgaacucugaugagcuguccuauuggcgaggugccaucucccuacaacucccguuucgaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuuuaccgugaugacagauggaccaucugacggccaggcuuccuacaaaaucuuccggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuuuaaucagaaccucgaauaucagauaggauacaucuguucaggcauuuucggcgauaauccgaggcccaacgacaaaaccgggaguugcggaccuguuuccagcaauggugcgaacggcgugaagggguuuucuuucaaguauggaaacggcguauggaucggucggacaaaaucaaucaguagccgcaauggguuugagaugauuugggauccaaacggcuggaccggaacggacaauaacuucuccauaaagcaagacaucgugggcauuaaugaauggucuggguacucggggagcuucguccagcaucccgagcugacuggucuggauuguauccgaccuugcuuuuggguggaacucauuagaggcaggccaaaagagaacacaaucuggaccuccgggucaaguauaucuuucuguggaguuaauagcgacacugugggcugguccuggcccgauggugcagaguuaccguuuacaaucgacaaguga

SEQ ID NO: 147996 - RNA, 1413 nt, Artificial Sequence; identical to SEQ ID NO: 139477
  derived and/or modified sequence opt3 from neuraminidase__InfluenzaA__AJK00081

SEQ ID NO: 147997 - RNA, 1413 nt, Artificial Sequence; identical to SEQ ID NO: 138648
  derived and/or modified sequence opt3 from neuraminidase__InfluenzaA__AJK00093

SEQ ID NO: 147998 - RNA, 1413 nt, Artificial Sequence
  derived and/or modified sequence opt3 from neuraminidase__InfluenzaA__AJK00105
augagccccaaccagaagaucauuaccauaggcuccaucucuauugccaucgggauuaucucacugaugcuccaaauaggaaauacaaucaguauuugggcuagccacuccauccagacugguucucagaacaauacgggcauuugcaaccagagaaucauaaccuacgaaaauucgacaugggugaaccauacuuaugucaauauuaacaauaccaacguuguggcaggggaggacaaaacaucaguaacccuugccggaaauagcagucuguguuccaucucuggcugggcgauuuacacuaaggauaacagcaucaggaucgguuccaaaggggacguguucgucauucgggagccuuuuauaucaugcagucacuuggaaugucgcacauucuuuuuaacccaaggagcucugcuaaaugauaagcauagcaacggcacggugaaagaccgaucuccauaucgugcccucauguccugcccgcugggcgaggcacccucaccuuacaauagcaaguucgaaaguguugccuggucugcuuccgcaugucacgaugggaugggauggcuuacuaucgguauuagcggcccagacaacggggccguggcuguccugaaguauaacggaaucauaaccggcacaauuaaaucguggaagaaacagaucuugagaacucaggagucugagugcguguguaugaaugguuccugcuuuaccaucaugacagaugggcccucaaacaaggccgcgaguuacaaaauuuucaagaucgaaaagggaaaaguaaccaagagcauugagcucaaugcaccuaacuuucauuaugaagaguguuccugcuacccagacacgggcauaguuaugugugugugcagggauaauuggcacggcucuaaccggcccugggucagcuucaaucagaaccuggacuaccaaaucggguauauuugcucaggaguguuuggugauaauccucgcccagaggacggcgaagggaguuguaacccggugacugucgauggagccaauggcguuaaagguuucuccuacaaguaugacaacgggguguggaucggcagaacaaaaagcaauaggcugcggaagggauuugagaugaucugggaccccaacggcuggaccaauacugauucugacuucucaguaaaacaggauguggucgcuauuacagacuggaguggguacagcggauccuuugugcagcacccugaacucaccgguuuagauugcauacgcccauguuucuggguugagcuggugcgaggccuucccagagaaaacacgaccaucuggacaucugggucgagcauuuccuucugcggagucaacucagacacugccaauuggaguuggccugauggcgcagaguugccauuuaccaucgacaaguga

SEQ ID NO: 147999 - RNA, 1410 nt, Artificial Sequence; identical to SEQ ID NO: 141029
  derived and/or modified sequence opt3 from neuraminidase__InfluenzaA__AJK00116

SEQ ID NO: 148000 - RNA, 1410 nt, Artificial Sequence; identical to SEQ ID NO: 139861
  derived and/or modified sequence opt3 from neuraminidase__InfluenzaA__AJK00127

SEQ ID NO: 148001 - RNA, 1410 nt, Artificial Sequence; identical to SEQ ID NO: 138754
  derived and/or modified sequence opt3 from neuraminidase__InfluenzaA__AJK00138

SEQ ID NO: 148002 - RNA, 1350 nt, Artificial Sequence
  derived and/or modified sequence opt3 from neuraminidase__InfluenzaA__AJK00152
augaaccccaaucagaagaucauuaccauaggcagcaucugcauggugacagggauugucucccugaugcuccaaaucggaaacauuaucucuauguggguuucacacaguauacagacuagaaaucagcaucagacggagccuaucaggaacaccaauuuccuuacagaaaacgccguggcuagcguaacucuggcagguaauuccucuuuguguccaauucggggcugggccgugcacucgaaagacaacucaauccgcauugggagcaagggagaugucuuugugauccgagagccguucauaaguugcucccauuuagaaugucguaccuuuuuccugacacaaggcgcgcuaauuaaugacaaacacucuaacgguaccguuaaggauagaagcccccauaggacucucauguccugcccugugggggaggcuccaucacccuacaauagucgguuugaaagcgucgccuggucugcauccgccugucacgacggaacaucauggcugaccaucggcauuagcggcccugauaacggggcuguggcaguacuuaaauauaauggaaucaucacggacacuauuaagaguuggcgcaacaauauacugagaacccaggagucugagugcgccuguguuaacgguuccugcuucacagugaugacugauggcccaagcaacgggcaggcuucguacaagaucuuuaaaauggaaaagggaaaagucgugaagucuguggaguugaaugcccccaacuaucacuacgaagaguguuccugcuauccugacgcgggcgagauuaccugugucugcagggauaauuggcaugguucaaaccggccauggguuaguuucaaucagaaccucgaauaccaaaucggguauauaugcagcggaguguuuggcgacaauccgcgccccaacgauggcacaggguccuguggaccuguaucuccaaauggugcauacggcauuaaaggguucagcuuuaaguacggaaacggcguguggaucggucgaaccaagucaacgaauaguagauccggguucgagaugaucugggaccccaacggcuggacuggaacagauagcgacuuuucugucaaacaggacauuguggaaaucaccgauuggucaggcuauagugggagcuucguucagcacccugagcugacuggacuggacugcauuaggccauguuucuggguggaacucauacggggucgucccaaggaguccacaaucuggaccucuggcucgagcauuuccuuuugcggggucaauucagauacggugaguuggucuuggccggacggagccgaguuaccuuucaccaucgauaaauga

SEQ ID NO: 148003 - RNA, 1350 nt, Artificial Sequence
  derived and/or modified sequence opt3 from neuraminidase__InfluenzaA__AJK00167
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacgcuaauuuccuuacugaaaacgcaguggccagcguaacgcuggcgggcaauuccucuuuguguccagugagggggugggcuguccacucgaaagacaacucaauccggauuggaagcaagggcgauguguuuguuauccgcgagccguucauaaguugcucccauuuagaaugucgaaccuuuuuccugacacaaggugcccuacucaaugacaaacacucuaacgggacugugaaggaucguagcccccauagaacccugauguccugcccugucggagaggcaccaucacccuacaauaguagguuugaaagcguggccuggucugcuuccgcaugucacgacggcacaucauggcuuaccauuggcaucagcgggccugauaacggagccguagcuguucugaaauauaaugguauuaucacugacacaaucaagaguuggcggaacaauauuuugcgcacccaggagucugagugcgccugugugaacggcuccugcuucacggucaugacugaugggccaagcaacggacaggcgucguacaagauauuuaaaauggaaaagggcaaaguggugaagucugucgagcucaaugcacccaacuaucacuacgaagaguguuccugcuauccugacgccggugagaucaccuguguuugcagagauaauuggcaugggucaaacaggccaugggugaguuucaaucagaaccuggaauaccaaauuggauauaucugcagcggcguauuuggcgacaauccgcggcccaacgaugggacaggauccugugguccugugucuccaaauggcgcuuacgggauaaaaggauucagcuuuaaguacggcaacggugucuggauugggcgcacuaagucaaccaauagucgauccggcuucgagaugaucugggaccccaacggauggacagaaaccgauagcaauuuuucugugaaacaggacaucguugccauuacggacuggucaggcuauagugggagcuucgugcagcacccugagcugacuggacucgauugcaucagaccauguuucugggucgaauuaauuaggggucggcccaaggaguccacaauauggaccucuggcucgagcaucuccuuuugcggggugaacucagacacuguaaguuggucuuggccggauggagcagagcugccuuucacaauugacaaauga

SEQ ID NO: 148004 - RNA, 1350 nt, Artificial Sequence
  derived and/or modified sequence opt3 from neuraminidase__InfluenzaA__AJK00178
augaaccccaaucagaagaucauuaccauaggcagcaucugcauggugauugggaucgucucccugaugcuccaaauuggaaacaugaucucuauaugggccucacacaguaucagaacagguaaucagaaccagguugagccuauuaucaauacuaacuucccaacggaaaaagcugcagccagcauuacccuugcgggcaauuccucucuguguccgaucagggggugggcuauacauucgaaggacaacucaauucggaucggaagcaaaggcgauguguuuguaauucgcgagcccuucaucaguugcucccacuuggaaugucgaacauuuuucuuaacucagggugcccugcuaaaugacaagcauucuaacgggaccgugaaagaucguagcccucacagaacacucauguccugcccagucggagaggcacccucaccuuacaauaguagguuugaaagcguggccuggucugcuuccgcaugucaugacggcaccucauggcugacuaucggcauuagcgggccagauaacggagccguugcugugcuuaaguauaaugguauaaucacagacaccauuaagacguggcggaacaauauccugcgcacucaagagagugagugcgccugugucaacggcucuugcuucaccgugaugacagaugggcccuccgacggacaggcgagcuacaaaauauuuaagauggaaaaaggcaagguaauuaaaucgguugaguuggaugcaccuaacuaucacuacgaagaguguucuugcuauccagacgccggugagaucacuugugugugcagagauaauuggcacggguccaacaggccgugggucucauucaaucagaaccucgaauaccagaucggauauauuugcaguggcguguuuggcgacaauccccggccuaccgaugggacaggaagcugugguccagugucccauaacggcgcuuacggggucaagggauucucuuuuaaguacggcaaugguguuuggaucgggcgcaccaaaagccccaacucacgaaguggcuucgagaugauuugggacccuaauggaugguccgaaacggacagcucuuuuucagugaagcaagauauaguagccaucacugacuggaguggcuauagcggguccuucgugcagcacccagagcugacaggacuggauugcauuagacccuguuucugggucgaacucaucaggggucggccgaaagagucuaccguguggacuucgggcagcuccaucucauuuugcgggguuaacagugacacagugucuuggagcuggccugauggagcagaguuacccuucaccauugacaaguga

SEQ ID NO: 148005 - RNA, 1350 nt, Artificial Sequence
  derived and/or modified sequence opt3 from neuraminidase__InfluenzaA__AJK00199
augaaccccaaucagaagaucauuaccauaggcagcaucugcauggugauugggaucgucucccugaugcuccaaauuggaaacaugaucucuauauggguuucacacaguauccagacagguaaucagaaccagguggagccuauuaucaauacuaacuuccuuacggaaaaagccguagugagcauuacccuggcuggcaauuccucuuuguguccaaucagagggugggcaauacauucgaaggacaacucaauuaggaucggaagcaaaggcgaugucuuugugauucgggagccguucaucaguugcucccacuuagaaugucgcacauuuuuccugacucaaggugcccuacucaaugacaagcauucuaacgggaccguuaaagaucgaagcccccaccguacacugauguccugcccugugggagaggcgccaucacccuacaauaguagauuugaaagcgucgcuuggucugccuccgcaugucaugacggcaccucauggcuuacuaucggcauuagcgggccugauaacggagccgcugcagugcugaaguauaaugguauaaucacagacaccauuaagaguuggaggaacaauaucuugcggacgcaggagucugagugcgccuguguaaacggcuccugcuucacuguuaugaccgaugggccaagcgacggacaggcuucguacaaaauauuuaagauggaaaaaggcaaggugauuaaaucugucgagcucgaugcccccaacuaucacuacgaagaguguuccugcuauccugacgcgggugagaucacaugugugugccgcgauaauuggcacgggucaaacagaccaugggugaguuucaaucagaaccuggaauaccaaaucggauauauuugcagcggcgucuuuggcgacaauccgaggcccaacgaugggacuggauccuguucuccuguuagccauaauggugcauacggcgugaagggguucucauuuaaguacggaaacggcguauggaucggucggaccaaaaguccaaauucccgcagcggguucgagaugauuugggaccccaacggcuggucugaaacagacucaaguuuuagcgugaagcaggauauagucgccaucaccgacugguccggauauucuggcucguucgugcagcacccugagcugacggggcucgauugcauucgaccauguuucuggguugaauuaaucagaggaaggcccaaagagagcacuguguggacauccgguucaaguaucucuuuuugcggcgucaauagcgacaccguguccuggucauggccggauggggcugagcugccuuucacuauugacaaguga

SEQ ID NO: 148006 - RNA, 1350 nt, Artificial Sequence
  derived and/or modified sequence opt3 from neuraminidase__InfluenzaA__AJK00208
augaaccccaaucagaagaucauuaccauaggcagcaucugcauggugacagggauugucucccugaugcuccaaaucggaaacauuaucucuauguggguuucacacaguauacagacuagaaaucagcaucagacggagccuaucaggaacaccaauuuccuuacagaaaacgccguggcuagcguaacucuggcagguaauuccucuuuguguccaauucggggcugggccgugcacucgaaagacaacucaauccgcauugggagcaagggagaugucuuugugauccgagagccguucauaaguugcucccauuuagaaugucguaccuuuuuccugacacaaggcgcgcuacucaaugacaaacacucuaacgguaccguuaaggauagaagcccccauaggacucugauguccugcccugugggggaggcuccaucacccuacaauagucgguuugaaagcgucgccuggucugcauccgccugucacgacggaacaucauggcuuaccauuggcaucagcggcccugauaacggggcuguggcaguacugaaauauaauggaauuaucacggacacuaucaagaguuggcgcaacaauauuuugagaacccaggagucugagugcgccuguguuaacgguuccugcuucacagugaugacugauggcccaagcaacgggcaggcuucguacaagauauuuaaaauggaaaagggaaaagucgugaagucuguggagcucaaugcccccaacuaucacuacgaagaguguuccugcuauccugacgcgggcgagaucauuugugucugcagggauaauuggcaugguucaaaccggccauggguuaguuucaaucagaaccuggaauaccaaaucggguauauaugcagcggaguguuuggcgacaauccgcgccccaacgauggcaccggguccuguggaccuguaucuccaaauggugcauacggcauuaaaggguucagcuuuaaguacggaaacggcguguggaucggucgaacaaagucaaccaauaguagauccggguucgagaugaucugggaccccaacggcuggacgggaacugauagcgacuuuucugucaaacaggacauuguggaaaucacagauuggucaggcuauagugggagcuucguucagcacccugagcugaccggacucgacugcauuaggccauguuucuggguggaauuaauacggggucgucccaaggaguccacuaucuggacaucuggcucgagcauuuccuuuugcggggucaauucagauaccgugaguuggucuuggccggacggagccgagcugccuuucacgaucgauaaauga

SEQ ID NO: 148007 - RNA, 1350 nt, Artificial Sequence
  derived and/or modified sequence opt3 from neuraminidase__InfluenzaA__AJK00219
augaaccccaaucagaagaucauuaccauaggcagcaucugcauggugacagggauugucucccugaugcuccaaaucggaaacauuaucucuauguggguuucacacaguauacagacuagaaaucagcaucaggccgagccuaucaggaacacgaauuuccuuaccgaaaacgcuguggcaagcguaacacuggccgguaauuuguccuuauguccaauucggggcugggcggugcacucuaaagacaacaauauccgcauugggucgaagggagaugucuuugugauccgagagccguucauaucaugcagccaucuggaaugucguaccuuuuuccuaacucaaggcgcucuccugaacgacaaacacaguaaugguacaguuaaggauagaagcccccauaggacccuuaugucuugcccugugggggaggccccaagccccuacaacucccgguuugaaucagucgcauggagugccagcgcuugucacgacggaacuucuuggcugacaauuggcaucuccggcccugauaauggggcaguggccguauugaaauauaacggaauuaucaccgacacgaucaagucauggcgcaauaacauucucagaacucaggagagcgagugcgcuuguguuaacgguaguugcuucaccgugaugacagauggcccaucuaaugggcaggccuccuacaagauauuuaaaauggaaaagggaaaagucgugaaguccguggagcugaacgcgcccaauuaucacuacgaagaguguucgugcuauccugacgcaggcgagaucauuugugucugcagggauaacuggcaugguucuaaucggccauggguuuccuucaaccagaaucuggaauaccaaaucggguauauaugcucaggaguguuuggcgacaacccgcgccccaaugauggcacugggaguuguggaccuguaagcccaaacggugccuacggcauuaaaggguucuccuuuaaguacggaaauggcguguggaucggucgaaccaagucuacaaacagcagaucaggguucgagaugaucugggaccccaauggcuggaccggaacggauagugacuuuuccgucaaacaggacauuguggaaaucacugauuggagcggcuauucugggucauucguucagcacccugagcucacaggauuagacugcauuaggccauguuucuggguggaacugauacggggucgucccaaggagaguaccaucuggacuagcggcuccucuauuucguuuugcggggucaacagcgauacaguguccuggucauggccggacggagcugagcuuccuuucaccaucgauaaauga

SEQ ID NO: 148008 - RNA, 1350 nt, Artificial Sequence
  derived and/or modified sequence opt3 from neuraminidase__InfluenzaA__AJK00230
augaaccccaaucagaagaucauuaccauaggcagcaucugcauggugacagggauugucucccugaugcuccaaaucggaaacauuaucucuauguggguuucacacaguauacagacuagaaaucagcaucagacggagccuaucaggaacaccaauuuccuuacagaaaacgccguggcuagcguaacucuggcagguaauuccucuuuguguccaauucggggcugggccgugcacucgaaagacaacucaauccgcauugggagcaagggagaugucuuugugauccgagagccguucauaaguugcucccauuuagaaugucguaccuuuuuccugacacaaggcgcgcuaauuaaugacaaacacucuaacgguaccguuaaggauagaagcccccauaggacucucauguccugcccugugggggaggcuccaucacccuacaauagucgguuugaaagcgucgccuggucugcauccgccugucacgacggaacaucauggcugaccaucggcauuagcggcccugauaacggggcuguggcaguacuuaaauauaauggaaucaucacggacacuauuaagaguuggcgcaacaauauacugagaacccaggagucugagugcgccuguguuaacgguuccugcuucacagugaugacugauggcccaagcaacgggcaggcuucguacaagaucuuuaaaauggaaaagggaaaagucgugaagucuguggaguugaaugcccccaacuaucacuacgaagaguguuccugcuauccugacgcgggcgagauuaucugugucugcagggauaauuggcaugguucaaaccggccauggguuaguuucaaucagaaccucgaauaccaaauaggguauauuugcagcggaguguuuggcgacaauccgcgccccaacgauggcaccggguccuguggaccuguaucuccaaauggugcauacggcaucaaaggguucagcuuuaaguacggaaacggcguguggaucggucgaacaaagucaaccaauaguagauccggguucgagaugauuugggaccccaacggcuggacgggaacugauagcgacuuuucugucaaacaggacaucguggaaauuacagauuggucaggcuauagugggagcuucguucagcacccugagcugaccggacuggacugcauaaggccauguuucuggguggaacucauccggggucgucccaaggaguccacuauuuggacaucuggcucgagcaucuccuuuugcggggucaauucagauaccgugaguuggucuuggccggacggagccgaguuaccuuucacgaucgauaaauga

SEQ ID NO: 148009 - RNA, 1380 nt, Artificial Sequence
  derived and/or modified sequence opt3 from neuraminidase__InfluenzaA__AJS18470
augaaccccaaucagaagaucacuugcauuagcgccacaggcgugacucuguccgucguuucucuccuuauagggaucgcuaaccugggauugaauauugguuuacacuacaaaguggacgauucaacgaccaucaacauuccuaauaugaacgagacaaauccaacuaucaccaacauaacaaauaucauuguaaacaagaaugaagagagaaccuuccugaaccuaacuaaaccgcucugugaagugaauaguuggcauauccugagcaaggacaacgcaauuaggaucggcgaggaugcccacauacuugucacacgggaacccuaucuguccugcgacccucaagggugucgcauguuugcguugucucagggaaccacgcuccgaggccgucaugcuaaugguacuauucacgauagaucgccauucagggcccugaucucaugggagauggggcaggcacccagcccuuacaacacccggguggagugcauuggauggaguuccacaucuugucaugacggcaucagccgcauguccaucugcauuucaggcccaaacaauaacgccagugcuguugugugguauagagggaggcccgucacugaaauaccuagcugggugggaaauauccugcggacccaggagucugaauguguaugccacaaagguauuuguccaguugugaugacagauggcccggcaaacaauaaggccgcuaccaagaucauauacuuuaaagaggggaagauucagaaaaucgaggaacuccaaggaaacgcccagcacgucgaggaaugcuccuguuauggcgcggcagguaugaucaagugcgugugccgcgacaauuggaaaggggccaaccgacccauuaucacgauugauccugagaugaugacucauacaucaaaguacuuauguagcaagauacugaccgacaccaguagaccaaaugaucccacaaacggaaauugcgacgcuccuaucauuggcggcucuccagaucccggggugaaaggauucgccuaucuugacggugaaaacuccugguugggcaggaccaucagcaaggacucgcggucuggguacgagaugcugaaagucccgaaugcagagacggauacccaguccggaccuacaucauaccaacuaaucguuaacaaucagaacuggaguggcuauagcggugcuuuuauugacuacugggccaacaagggguguuucaaucccugcuuuuauguggaacucauacguggccgcccaaaagagaucgauguacuguggacuuccaacucuaugguggcgcuuuguggaagcagagaaaggcugggcucauggaguuggcacgacggggccgagauuaucuacuucaaguga

SEQ ID NO: 148010 - RNA, 1380 nt, Artificial Sequence
  derived and/or modified sequence opt3 from neuraminidase__InfluenzaA__AJS18481
augaaccccaaucagaagauuaccugcaucagcgccacaggcgugacucuguccgucguuucucuccuuauagggaucgcuaaccugggauugaauauugguuuacacuacaaagugucagacaguacgaccaucaacagcccuaauaugaacgagacaaauccaacuaccacaaacauuaccaauaucauaguaaacaagaaugaagagagaacuuuccugaaccuaacaaaaccgcucugugaagucaauuccuggcauauccugucuaaggauaacgcaauuaggaucggcgaggaagcccacauucuugugacccgggagcccuaucugucgugcgacccucaagggugucgcauguuugcguugucacagggaacgacucuccgaggccgucaugcuaaugguaccauccacgauagaagcccauucagggcccugauaaguugggagauggggcaggcacccuccccuuacaacacacggguggaaugcauuggauggucuagcacuuccugucaugacggcaucucacgcaugaguauuugcaucagcggcccaaacaauaacgccucugcuguugugugguauagagggaggcccgucaccgagaucccuuccugggcaggaaauauucugcggacacaggaaucagagugugugugccacaaagguauauguccaguaguuaugaccgauggcccggccaacaauaaggcugccacgaagaucauuuacuuucgcgaggggaaaauccaaaagauagaggaacuccagggaaacgcgcagcacauugaagagugcagcuguuauggcgcagccgguaugaucaaaugcgcuugccgagacaauuggaagggggccaacagacccaucauuacuaucgauccugaaaugaugacacauaccaguaaauacuuauguucuaagauucugacugacacauccaggccaaaugaucccaccaacggaaauugcgacgcaccugugacgggcggcagcccagaucccgggauaaagggauucgcuuuucuugacggugagaacucgugguugggccggaccaucucuaaaaauucccguucaggguaugagaugcugaaggucccgaacgccgaaacagauacucagaguggaccuaccagcuaccaacuaauugugaauaaccagaacugguccggcuacucuggugcguucaucgacuauugggccaauaaagaguguuuuaaccccugcuucuacguggaacucauccgcgggagaccaaaggagagcgacguccuguggacaucaaauaguaugguugcacuuuguggcuccagggaacggcugggaagcuggucuuggcacgauggcgcugagauuauauauuuuaaauga

SEQ ID NO: 148011 - RNA, 1410 nt, Artificial Sequence
  derived and/or modified sequence opt3 from neuraminidase__InfluenzaA__AKA59350
augaaccccaaucagaagaucauuaccauaggcagcgugugcaugacaaucggggucgccaaccugauucuccaaaucggaaauauuaucuccauauggaucucucacucaauucagcuugguaaccagaaucagaucgagacuuguaaccaaaguguuauuacguacgaaaauaacaccugggugaaucagacagacguaaacaucagcaauacuaacuucgcugcaggccaguccguggucucugugaaacuggccggaaauucgucauugugcccuguuagcggaugggcgauauauaguaaggauaacuccauuagaaucggcucuaaaggugacguguuugucauuagggagccauucaucagcuguuccccguuagaaugccggaccuuuuuccugacacagggggcucuacucaaugauaagcauucaaacggaaccaucaaagaccgcagucccuaccgaacucugaugagcuguccuauuggcgaggugccaucucccuauaacucccguuuugaaucaguagccuggagcgcaagugccugccacgauggcauaaauuggcuuacaaucgggauuucuggaccugacaacggugcuguugcagugcugaaguacaauggcaucauaaccgauacgauuaaguccuggagaaacaauaucuugaggacucaagagagcgagugugucugcgugaacgggucguguuucaccgugaugacagacggaccaucuaauggccaggccuccuauaaaaucuuucggauugaaaaggguaaaaucgucaagucaguugagaugaacgcucccaauuaccauuaugaagagugcaguuguuacccugauagcuccgagauuacuugcgugugccgcgacaacuggcacgggucuaauagaccaugggugagcuucaaccagaaucucgaauaccagauaggauauaucuguucaggcauuuuuggcgauaacccgaggcccaaugacaaaaccgggaguugcggaccuguauccagcaacggugccaacggcgucaagggguucucuuuuaaguacggaaauggcguguggaucggucggacaaaaucaaucaguagccgcaacggguucgagaugauuugggauccaaauggcuggaccggaacggacaacaauuuuuccauaaagcaagacaucguuggcauuaacgaauggucuggguauucggggagcuucgugcagcaucccgagcugacuggucuggauuguauccgaccuugcuucugggucgaacucauuagaggcaggccaaaagagaauacaguguggaccuccgggucaaguaucucuuuuuguggaguaaacagcgacacuguuggcugguccuggcccgauggugcggaguuaccguucacaauagacaaguga

SEQ ID NO: 148012 - RNA, 1410 nt, Artificial Sequence
  derived and/or modified sequence opt3 from neuraminidase__InfluenzaA__AKA59352
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaaccuggcuguaggccaguccguggucucuaccaaauuggcaggaaauucgucauuaugcccugugagcggaugggccaucuacaguaaggacaacuccauaagaauuggcucuaaaggugauguuuucgugaucagggagccauuuauuagcuguuccccgcuggaaugccggacauucuuucuaacccagggggcgcuccugaaugacaagcauucaaacggaacuaucaaagaucgcagucccuaucgaacacuuaugagcuguccuaucggcgaggucccaucucccuacaacucccguuucgaaucaguggcuuggagcgccagugcaugccacgacggcauuaauuggcugaccauagggaucucuggaccugauaacggugccguagcuguuuugaaguauaauggcauuaucacggacacuauaaaguccuggagaaacaauauucucaggacccaagagagcgagugugcaugcgugaacgggucguguuuuacagucaugacugauggaccaucugacggccaggccuccuacaaaaucuuccggaucgaaaaggguaaaauugugaagucaguggagaugaaugcucccaacuaucauuacgaagagugcaguuguuacccugauagcuccgagauuaccugcgucugccgcgacaauuggcacgggucuaacagaccauggguuagcuuuaaucagaaccuggaauaucagaucggauacauauguucaggcaucuucggcgauaauccgaggcccaacgacaaaacagggaguugcggaccuguguccagcaauggugccaacggcguaaagggguuuucuuucaaguauggaaacggcguguggauuggucggaccaaaucaaucaguagccgcaauggguuugagaugaucugggauccaaacggcuggacgggaacugacaauaacuucuccauuaagcaagacauagucggcaucaaugaauggucuggguacucggggagcuuugugcagcaucccgagcugacaggucucgauuguauucgaccuugcuucuggguugaauuaaucagaggcaggccaaaagagaacaccauuuggacuuccgggucaaguaucucuuucuguggagugaauagcgacacagucggcugguccuggcccgauggugcggagcugccguuuaccauagacaaguga

SEQ ID NO: 148013 - RNA, 1410 nt, Artificial Sequence
  derived and/or modified sequence opt3 from neuraminidase__InfluenzaA__AKA59354
augaaccccaaucagaagaucauuaccauaggcagcgugugcaugacaaucggggucgccaaccugauucuccaaaucggaaauauuaucuccauauggaucucucacucaauucagcuugguaaccagaaucagaucgagacuuguaaccaaaguguuauuacguacgaaaauaacaccugggcuaaucagacauaugugaacaucagcaauacuaacuucgcagccggccaguccguagugucugucaaacuggcgggaaauucgucauugugcccugugagcgggugggcuauauacaguaaggacaacuccauuagaaucggcucuaaaggugauguuuuugugauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggucccaucucccuacaacucccguuuugaaucaguggcauggagcgccagugcuugccacgacggcauaaauuggcuuacaaucgggauuucuggaccugauaacggugcaguagccguucugaaguauaauggcaucauaaccgacacgauuaaguccuggagaaacaauaucuugaggacucaagagagcgagugugugugcgucaacgggucguguuucaccgugaugacagauggaccaucuaauggccaggcuuccuacaaaaucuuucggauugaaaaggguaaaaucgugaagucagucgagaugaacgcccccaauuaucauuacgaagagugcaguuguuacccugacagcuccgagauuacuugcguuugccgcgauaacuggcacgggucuaauagaccaugggugagcuucaaccagaaucucgaauaucagauaggauacaucuguucaggcauuuuuggcgacaacccgaggcccaaugauaaaaccgggaguugcggaccuguauccagcaacggugcgaacggcgugaagggguucucuuuuaaguauggaaauggcgucuggaucggucggacaaaaucaaucaguagccgcaacggguucgagaugauuugggacccaaauggcuggaccgaaacggauaacaauuuuuccauaaagcaagacaucgugggaauuaacgaguggucuggcuacucggggagcuucguucagcaucccgaacugacuggacuggacuguauccgaccuugcuucuggguggagcucauuagagguaggccaaaagagaauacagucuggaccuccggcucaaguaucucuuuuuguggggugaacagcgauacuguaggaugguccuggcccgacggcgcagaauuaccguucacaauagauaaguga

SEQ ID NO: 148014 - RNA, 1380 nt, Artificial Sequence
  derived and/or modified sequence opt3 from neuraminidase__InfluenzaA__AKS48026
augaaccccaaucagaagauuaccugcaucagcgccacaggcgugacucuguccgucguuucucuccuuauagggaucgcuaaccugggauugaauauugguuuacacuacaaagugucagacaguacgaccaucaacauuccuaauaugaacgagacaaauccaacuaccacaaacaucaccaauauaaucguaaacaagaaugaagagagaacuuuccugaaccuaacaaaaccgcucugugaagugaauagcuggcauauucuguccaaggauaacgcaaucaggauuggcgaggacgcccacauccuugucacccgggaacccuaucugucuugcgauccucaagggugucgcauguuugcguugucgcagggaacgacucuccgaggccgucaugcuaaugguaccauacacgacaaaucaccauucagagcccugauuagcugggagauggggcaggcacccaguccuuacaacacaaggguggagugcaucggaugguccucuacuagcugucaugauggcauuucccggaugucaaucugcaucaguggcccaaacaauaacgccagcgcuguugugugguaucgcgggagacccgucaccgaaauuccuucuugggugggaaauauacugaggacacaggaguccgaauguguaugccacaaggguaucuguccaguugugaugaccgacggcccggcaaacaauaaggccgcuacgaaaauuaucuacuuuaaggaggggaaaauacaaaagauugaggaacuccagggaaacgcccagcacaucgaggaaugcucauguuauggcgcggcagguaugaucaaaugcgucugccgggauaauuggaagggggccaaccgccccauuaucacuauugacccugagaugaugacacauaccagcaaguacuuauguaguaaaauacugacugauacaucucgaccaaaugaccccaccaacggaaauugcgaugaaccuaucacgggcggcuccccagaccccggggugaagggauucgcuuuucuugauggugagaacagcugguugggcagaaccauuucgaaagacucuagguccggguaugagaugcugaaggugccgaaugccgaaacagacacucagucaggaccuaccaguuaccaacuaaucgucaacaaucagaacuggagcggcuacuccggugcauucaucgauuauugggcuaacaaagaguguuuuaaucccugcuucuacguugaacucauucgggggcguccaaaggagauagacgugcugugggccucuaacagcaugguagcgcuuuguggcucacgcgaaagacugggaaguugguccuggcacgauggcgccgagaucauuuauuuuaaauga

SEQ ID NO: 148015 - RNA, 1380 nt, Artificial Sequence
  derived and/or modified sequence opt3 from neuraminidase__InfluenzaA__AKS48040
augaaccccaaucagaagauuaccugcaucagcgccacaggcaugacucuguccguggucucucuccuuauagggaucgcuaaccugggauugaauauugguuuacacuacaaaguuucagacaguacgaccaucaacauuccuaauaugaacgagacaaauccaacuaccacaaacaucaccaauauaaucgugaacaagaaugaagagagaacuuuccugaaccuaacaaaaccgcucugugaaguaaauagcuggcauauucuguccaaggauaacgcaaucaggauuggcgaggacgcccacauccuugugacccgggaacccuaucugucuugcgauccucaagggugucgcauguuugcguugucgcagggaacgacucuccgaggccgucaugcuaaugguaccauacacgacagaucaccauucagggcccugauuagcugggagauggggcaggcacccaguccuuacaacacacgggucgagugcaucggaugguccucuacuagcugucaugauggcauuucccgcaugucaaucugcaucaguggcccaaacaauaacgccagcgcugugguuugguauagagggaggcccgugaccgaaauuccuucuugggucggaaauauacugcggacacaggaguccgaaugugugugccacaaagguaucuguccaguaguuaugaccgacggcccggcaaacaauaaggccgcuacgaagauuaucuacuuuaaagaggggaagauacagaaaauugaggaacuccaaggaaacgcccagcacaucgaggaaugcucauguuauggcgcggcagguaugaucaagugcgugugccgcgauaauuggaaaggggccaaccgacccauuaucacuauugacccugagaugaugacacauaccagcaaguacuuauguaguaagauacugacugauacaucuagaccaaaugaccccaccaacggaaauugcgaugcuccuaucacgggcggcuccccagaccccggggucaaaggauucgccuuucuugauggugaaaacagcugguugggcaggaccauuucgaaggacucucgguccggguaugagaugcugaaagugccgaaugcagagacagacacucagucaggaccuaccaguuaccaacuaaucgugaacaaucagaacuggagcggcuacuccggugcuuucaucgauuauugggccaacaaggaauguuuuaaucccugcuucuacgucgagcucauucgugggcgcccaaaagaaauagacguucugugggcgucuaacagcaugguggcccuuuguggcucaagagagaggcugggaaguugguccuggcacgauggcgcagaaaucauuuauuuuaaguga

SEQ ID NO: 148016 - RNA, 1380 nt, Artificial Sequence
  derived and/or modified sequence opt3 from neuraminidase__InfluenzaA__ALO75898
augaaccccaaucagaagauuaccugcaucagcgccacaggcgugacucuguccgucguuucucuccuuauagggaucgcuaaccugggauugaauauugguuuacacuacaaagugucagacaguacgaccaucaacauuccuaauaugaacgagacaaauccaacuaccacaaacaucaccaauauaaucguaaacaagaaugaagagagaacuuuccugaaccuaacaaaaccgcucugugaagugaauagcuggcauauucuguccaaggauaacgcaaucaggauuggcgaggacgcccacauccuugucacccgggaacccuaucugucuugcgauccucaagggugucgcauguuugcguugucgcagggaacgacucuccgaggccgucaugcuaaugguaccauacacgacagaucaccauucagggcccugauuagcugggagauggggcaggcacccaguccuuacaacacacggguggagugcaucggaugguccucuacuagcugucaugauggcauuucccgcaugucaaucugcaucaguggcccaaacaauaacgccagcgcuguugugugguauagagggaggcccgucaccgaaauuccuucuugggugggaaauauacugcggacacaggaguccgaauguguaugccacaaagguaucuguccaguugugaugaccgacggcccggcaaacaauaaggccgcuacgaagauuaucuacuuuaaagaggggaagauacagaaaauugaggaacuccaaggaaacgcccagcacaucgaggaaugcucauguuauggcgcggcagguaugaucaagugcgucugccgcgauaauuggaaaggggccaaccgacccauuaucacuauugacccugagaugaugacacauaccagcaaguacuuauguaguaagauacugacugauacaucuagaccaaaugaccccaccaacggaaauugcgaugcuccuaucacgggcggcuccccagaccccggggugaaaggauucgccuuucuugauggugaaaacagcugguugggcaggaccauuucgaaggacucucgguccggguaugagaugcugaaagugccgaaugcagagacagacacucagucaggaccuaccaguuaccaacuaaucgucaacaaucagaacuggagcggcuacuccggugcuuucaucgauuauugggccaacaaggaauguuuuaaucccugcuucuacguugagcucauucgugggcgcccaaaagaaauagacgugcugugggcgucuaacagcaugguagcccuuuguggcucaagagagaggcugggaaguugguccuggcacgauggcgcagaaaucauuuauuuuaaguga

SEQ ID NO: 148017 - RNA, 1380 nt, Artificial Sequence; identical to SEQ ID NO: 148016
  derived and/or modified sequence opt3 from neuraminidase__InfluenzaA__ALO75910

SEQ ID NO: 148018 - RNA, 1380 nt, Artificial Sequence
  derived and/or modified sequence opt3 from neuraminidase__InfluenzaA__ALO75922
augaaccccaaucagaagauuaccugcaucagcgccacaggcgugacucuguccgucguuucucuccuuauagggaucgcuaaccugggauugaauauugguuuacacuacaaagugucagacaguacgaccaucaacauuccuaauaugaacgagacaaauccaacuaccacaaacaucaccaauauaaucguaaacaagaaugaagagagaacuuuccugaaccuaacaaaaccgcucugugaagugaauagcuggcauauucuguccaaggauaacgcaaucaggauuggcgaggacgcccacauccuugucacccgggaacccuaucugucuugcgauccucaagggugucgcauguuugcguugucgcagggaacgacucuccgaggccgucaugcuaaugguaccauacacgacagaucaccauucagggcccugauuagcugggagauggggcaggcacccaguccuuacaacacacggguggagugcaucggaugguccucuacuagcugucaugauggcauuucccgcaugucaaucugcaucaguggcccaaacaauaacgccagcgcuguugugugguauagagggaggcccgucaccgaaauuccuucuugggugggaaauauacugcggacacaggaguccgaauguguaugccacaaagguaucuguccaguugugaugaccgacggcccggcaaacaauaaggccgcuacgaagauuaucuacuuuaaagaggggaagauacagaaaauugaggaacuccaaggaaacgcccagcacaucgaggaaugcucauguuauggcgcggcagguaugaucaagugcgucugccgcgauaauuggaaaggggccaaccgacccauuaucacuauugacccugagaugaugacacauaccagcaaguacuuauguaguaagauacugacugauacaucuagaccaaaugaccccaccaacggaaauugcgaugaaccuaucacgggcggcuccccagaccccggggugaaaggauucgcuuuucuugauggugagaacagcugguugggcaggaccauuucgaaggacucucgguccggguaugagaugcugaaagugccgaaugccgaaacagacacucagucaggaccuaccaguuaccaacuaaucgucaacaaucagaacuggagcggcuacuccggugcauucaucgauuauugggcuaacaaggaguguuuuaaucccugcuucuacguugaacucauucgugggcgcccaaaagagauagacgugcugugggccucuaacagcaugguagcgcuuuguggcucaagagaaaggcugggaaguugguccuggcacgauggcgccgagaucauuuauuuuaaguga

SEQ ID NO: 148019 - RNA, 1401 nt, Artificial Sequence
  derived and/or modified sequence opt3 from neuraminidase__InfluenzaA__ALT20083
augaaccccaaucagagaaucaccgccauuggcagcgugucccugauaaucgcuauuaucugccuccuuaugcaaauugcaauccugacaacuacgaugaccuugcacuucaggcagaacgaguguucuaauccuucaaacaaucaggucaugccaugcgaaccgauaaucauugagcggaacacaguucauuuaaauaguacuaccaucgaacgcgagauuugucccaagguggccgaauacaaaaacuggagcaagccucagugccaaaucacaggguuugcgccauucuccaaagacaauucuauacgacugucggcuucaggagauauuuggguaacccgugagcccuaugugagcuguagucuaaacaagugcuaccaguuugcccucggucagggcacuacacugaaaaauaagcacuccaacgggaccacgcaugacagaacuccucacaggacccuucugaugaaugaguugggagucccauuccaucucggcacaaaacagguguguaucgcauggucuagcuccucaugcuaugaugguaaggccuggcugcacguuugugugacuggggacgauaagaacgcuaccgcaaguauuaucuacgacggaaugcuggucgauagcaucggcucuugguccaaaaauauucuccggacacaagaaucagagugcguguguauaaacggaaccugcgccguaguuaugacggacgggagcgcuaguggaaaggccgauacucgcguguuauuuaucagagaagguaaaauuaucaacauaucuccccuguccggcagcgcgcagcacgucgaggagugcucguguuauccuagguacccagaagugcggugcgugugucgcgacaauuggaaggggucuaaccgaccgauucuuuauaucaauauggcagauuacuccaucgagucaaguuacgucugcagcggauugguuggcgacacacccagaaacgaugacuccucuagcucaaguaauuguagggacccuaacaaugaacggggugccccaggggugaagggaugggcuuucgaugacggcaacgauguauggaugggccguaccauuaaaaaugggucccgcagcggauaugagacuuuuagaguggucaacgguuggacaauggccaauucuaagucacagaucaacaggcaagugauuguugacaguaaugauuggagcggcuacuccgggauauucucuguggaaggcaaaaagugcaucaaccgguguuuuuaugucgagcugauucgaggccgcccccaggagccuagagugugguggaccucgaauagcaucaucguauucugcgguacguccgggaccuacggcacaggaucauggccagacggcgcaaacauuaacuuuaugcccauauga

SEQ ID NO: 148020 - RNA, 1410 nt, Artificial Sequence
  derived and/or modified sequence opt3 from neuraminidase__InfluenzaA__AMA65392
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaggggugaugucuuugugauccgggagccauucauuuccuguucaccguuggaaugccgcaccuuuuucuuaacacagggggcucugcuaaacgacaaacauaguaauggaaccaucaaggaucgaagccccuaucguacucucaugucuuguccuaucggcgagguaccaucccccuacaacucaagauuugaaagcguugccuggagugcaucugccugccacgacggcauuaacuggcugacaauagggaucuccggaccugauagcggugcuguggcaguccuuaaauauaauggcauuaucaccgacacgauaaagucguggaggaacaauauucugcggacucaagagucugagugugccugcgugaacggguccuguuucaccaucaugacagauggaccaucagacggccaggcuaguuacaagaucuuucgcauugaaaaagguaagaucauuaaaagcguggagaugaaggcccccaauuaucauuacgaagagugcuccuguuacccugauucuagcgagauaacuugcgucugcagagacaacuggcacgggucaaauaggccauggguuaguuucaaccagaauuuggaauaucagaugggauacaucuguuccggcguguuuggcgauaacccgcggcccaaugacaaaaccgggagcugcggaccuguaucuucaaacggugcgaauggcgugaagggguucaguuuuaaguauggaaacggcgucuggauuggucgcacaaaaagcaucuccucucgaaagggguucgagaugaucugggauccaaauggcuggaccggaacggacaacaaauuuucgauuaagcaagacauagugggcaucaacgaauggagcggguacuccggaucauucguucagcaucccgagcucacuggucuggauuguauuagaccuugcuucuggguggaacugaucaggggccggccagaggagaauacaauuuggaccagugggucuagcaucuccuuuuguggagucaacucagacacugugggcuggagcuggcccgauggugcagaacucccguucacaauagacaaauga

SEQ ID NO: 148021 - RNA, 1410 nt, Artificial Sequence
  derived and/or modified sequence opt3 from neuraminidase__InfluenzaA__AMA65394
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuaacacagggggcucugcuaaacgacaagcauaguaauggaaccaucaaagaucgcagccccuaucgaacucucaugucuuguccuaucggcgagguaccaucccccuacaacucacguuuugaaagcguugccuggagugcaucugccugccacgacggcauuaacuggcugacaauagggaucuccggaccugauagcggugcuguggcaguccuuaaguauaauggcauuaucaccgacacgauaaagucguggagaaacaauauucugaggacucaagagucugagugugccugcgugaacggguccuguuucaccaucaugacagauggaccaucagacggccaggcuaguuacaaaaucuuucggauugaaaaggguaaaaucauuaagagcguggagaugaaagcccccaauuaucauuacgaagagugcuccuguuacccugauucuagcgagauaacuugcgucugccgcgacaacuggcacgggucaaauagaccauggguuaguuucaaccagaauuuggaauaucagaugggauacaucuguuccggcguguuuggcgauaacccgaggcccaaugacaagaccgggagcugcggaccuguaucuucaaacggugcgaauggcgugaagggguucaguuuuaaauauggaaacggcgucuggauuggucggacaaagagcaucuccucucgcaaaggguucgagaugaucugggauccaaauggcuggaccggaacggacaacaaguuuucgauuaaacaagacauagugggcaucaacgaauggagcggguacuccggaucauucguucagcaucccgagcucacuggucuggauuguauucgaccuugcuucuggguggaacugaucagaggcaggccagaggagaauacaauuuggaccagugggucuagcaucuccuuuuguggagucaacucagacacugugggcuggagcuggcccgauggugcagaacucccguucacaauagacaaguga

SEQ ID NO: 148022 - RNA, 1410 nt, Artificial Sequence
  derived and/or modified sequence opt3 from neuraminidase__InfluenzaA__BAA00618
augaaccccaaucagaagaucauuaccaugggcagcguguccauaaucauugccaucgucugccugcucaugcaaauugcuauccuuguuacaacugugacgcugcacuucagacagcaugagucugacucaccuccaaguaaccagguaauaccgugugaacccaucauuaucgagaggaauauuaccgaaaucguguacuugaacaauacaacuauagagaaagaaaccugcccuaagagcgucgaguaucggaacugguccaaaccacaguguaagauuacaggguuugcacccuucucuaaagauaauucgauccgcuuaucagccggaggugacauuugggugacccgagagccuuacguuagcugcgauccaggcaaguguuaucaauuugcgcuggggcagggaacuacacuagacaacaagcacaguaaugauaccauccaugaccguaucccccacagaacgcuccugaugaacgaacuuggcgugccuuuccaucuggguacuaggcaggucugcauugcuugguccucuagcuccugucacgaugggaaagccugguugcacgugugcguaaccggagacgauaagaaugcaacagccucauuuauauacaacggccggcucguugacaguaucggcagcuggucucagaauauucugcgcacucaagaguccgaaugugugugcaucaacgggaccuguacagucgugaugaccgauggaucagcuagcgguagagcagacacgaggauacuguucauugaggagggcaaaaucgugcauaucaguccacucucuggguccgcccagcacgucgaagagugcagcugcuauccgcgguaccccgauguucgcuguauuugccgagacaauuggaagggaucgaacucuccugugguagacaucaacaugaaagauuauuccauugacucaaguuacguguguagcggcuuagucggugauacuccaagaaaugacgauagguccucuaagagcaacugccggaaucccaacaaugaacgugggaaccauggagugaagggcugggcuuuugacaauggcgaugacguuuggauggggcgcacaauaucaaaagaucugagaaguggauacgagaccuucaaggugaucgguggcugguccacuccuaacagcaaaucucagacaaauaggcaggucauuguggacucaaacaauuggaguggguauagcggaaucuuuuccguagaaggcaagucuuguaucaaccggugcuucuacguugagcuuauucgaggucgcaaacaagagaccagagugugguggacgucgaauagcauagucguguuuugugggaccuccggcacauauggaacuggcucauggccagauggggccaacaucgacuucaugcccauuuga

SEQ ID NO: 148023 - RNA, 1410 nt, Artificial Sequence
  derived and/or modified sequence opt3 from neuraminidase__InfluenzaA__BAA00619
augaaccccaaucagaagaucauuaccauaggcagcgugucccugacauucgccgcuaucugcuuucucaugcaaauugcaauccuugucacuacgguuacccugaacuucaaacaguacgagugugacccuccagccacaaaucaggugaugccgugcgaacccauuaucauagagagaaacaucacugaaauuguauauuugaccaauacaaccaucgagagggaaauuuguccuaaguuaguggaguaccggaacuggucuaaaccacagugcaagaucacuggguuugcgcccuucucaaaagauaauaguauacgccugagcgcuggaggugacauuugggucacacgagagccuuauguguccugugauccaggccguugcuaccaauuugcccuagggcagggaaccacgcucgacaacaagcacucuaaugauacuauccaugacagaacaccccacaggacccugcuuaugaacgaacugggcguuccuuuccauuuggguacucgccagguguguauugcauggucgucaagcaguugccacgaugggaaggccuggcuccaugucuguaucaccggauaugacaaaaaugcuacagcauccuuuaucuacgauggccgccugguggacucuauuggcagcugguccaagaacauacugagaacccaggagucagaaugcguauguaucaaugggacgugcacuguugugaugacagauggaagugccagcgguagggcugacacccggauucucuucaucgaggagggccgcauaguccacauuucuccauuauccgggucagcccaacacguggaagagugcagcuguuauccgcgauaccccggagugagaugcaucuguagggauaacuggaaaggcaguaaucggccugucguugacaucaacgugaaggacuacucuauuaacuccagcuauguaugcucgggucuggugggggauacuccacguaauaacgaccggucuuccaauucauacugucagaaccccaauaacgaaaaaggaaaucauggcgucaagggcugggcguuugaugacgggaacgauguguggaugggaagaacaaucagugaggacagcagguccgguuaucagaccuucaagguuauuggcggguggucuacgccuaauagcaaacuucagauaaaccggcaagugaucgucgauucagacaaucgaaguggauacuccggcauuuuuagcguggaagguaagucuugcaucaaccgcuguuucuauguagaguugaucagagggaggcggcaggagacccgcguuugguggacaucaaauaguauuguggucuuuugcggcacuagcggaaccuacggcacaggguccuggccagauggagcagacauaaaccugaugcccaucuga

SEQ ID NO: 148024 - RNA, 1410 nt, Artificial Sequence
  derived and/or modified sequence opt3 from neuraminidase__InfluenzaA__BAA00620
augaaccccaaucagaagaucaugaccauuggcagcgugucccugauaaucgccgcugucugcuuccucaugcaaauugcaauccuuguuacaacugugacgcugcacuuuaaacagugugagugcgacucuccuucaaacaaucagguaaagccaugugaaccgauuaucauagagagaaacaucaccgaaauuguguacuugaauaacacaacuaucgagaaagaaaccugccccaaguuagucgaguauaggaauuggaguaaaccucaguguaagauuacaggguucgccccauuuagcaaggauaacuccauccggcugucugcgggaggugacauaugggugacccgcgagcccuacguuucgugcgauccuggcaaauguuaucaauucgcucuagggcagggaacuacacucgacaauaagcauucaaacgauaccauucacgaccgaaucccacaucguacgcugcuuaugaaugaacugggcgugcccuuucacuuggguacuagacaggucugcauugccuggagcaguuccucuugucaugaugggaaagcauggcuccacgugugcguaaccggagacgauaagaacgccacagcuagcuucaucuacgacggcaggcugguugauuccaucggcucauggagucagaauauucugcggacucaagagagcgaaugugugugcauaaacgggaccugcacagucgugaugaccgacggaucugcauccggucgcgccgauacgagaauccucuuuauugaggagggcaaaaucgugcacauaucaccuuuaagcgggagugcucagcaugucgaagaguguucuugcuauccaagguacccgaauguucgguguauuugccgcgacaacuggaagggauccaaccgacccaucguggacaucaauaugaaggauuauagcauugacucgucuuacguauguuccggccuggugggugauacuccuagaaacgacgauaggucaaguaaaagcaauugccggaacccaaauaacgaaaaggggaaucacggagucaaaggcugggccuucgacaacggcgaugacguguggauggggcguacaaucuccaaggaucuucgcucuggauacgagaccuuuaaaguuauugguggcugguucacucccaauagcaagucacaggugaacagacaggucauaguggacagugauaauagguccggguauagcggaaucuuuucuguagaaggcaaaucauguauuaaccggugcuucuacguugaguugauccgaggucgcgggcaagagacaagagugugguggaccaguaauagcaucgucguguuuuguggcacguccggaaccuauggcaaggggucuuggccugacggagcgaacauuaauuucaugccaauauga

SEQ ID NO: 148025 - RNA, 1410 nt, Artificial Sequence
  derived and/or modified sequence opt3 from neuraminidase__InfluenzaA__BAA00621
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggaagggcucuaaucgccccguuguggacaucaacguaaaggacuacuccaucgauagcucguaugugugcucuggucuggucggggacacaccucgaaagaacgauagauccucaaguagcuacuguaggaauccaaacaaugaaaaaggaacccacggcgugaaaggcugggccuucgacgaugggaacgacguuuggaugggacggacgauuuccgaggauucucguagcgguuaugaaaccuuuaaggugaucggcggguggucaacacccaauaguaaacuucagauuaaccgccaggucauaguggacuccaaugauagaagcggauacucuggcaucuucucaguagaggguaagaguugcauuaacagguguuuuuauguugaguugauccgggggcgagaacaagagacucgcgugugguggaccagcaauuccaucgucguguucugcggcacaucuggaacuuacggcaccgggucguggccugacggagcggauauuaaccugaugccaauauga

SEQ ID NO: 148026 - RNA, 1413 nt, Artificial Sequence
  derived and/or modified sequence opt3 from neuraminidase__InfluenzaA__BAA06714
augaaccccaaucagaagaucauuaccauaggcagcaucuccauggccauugggaucauuucucugauccuccaaauaggaaacaucauuucaaucugggugagucacagcauucagacagguucccagaaucauacuggcaucugcaaccagagaauaauuacguacgaaaauucuaccugggucaaccaaacauauguuaauaucaacaauacuaacgugguagcugggaaagacaagaccucggugacacuugcaggaaauucaagccuguguccuauuaggggcugggccaucuacaccaaagauaacaguauccggauugguuccaagggggacgucuucgugauacgcgagccauuuaucucuugcagccacuuggagugucgaacuuucuuuuuaacacagggagcgcugcuaaaugauaaacauuccaacggcaccguuaaggaccguucaccguauagaaggcucaugaguugcccccugggcgaagcuccuagcccauacaauucucgguucgaguccauugccuggucagcaagcgccugucacgaugggaugggauggcuuacgaucgguauaaguggccccgacgauggggcuguggcaguccugaaguauaacggaauuaucacugaaaccaucaaaucuuggaagaaacgcauuuugagaacacaggaguccgagugcguguguguaaacggcagcugcuuuacuaucaugaccgacgguccuucgaaugggcaggccucuuacaggauuuucaagauagaaaaaggaaagguuacaaaguccaucgagcucgaugcuccaaacucacauuaugaagaguguaguugcuaccccgacaccggcacggugaugugugucugccgggauaauuggcacggcagcaaccgcccuuggguguccuuuaaucaaaaccuggacuaccagauuggguauaucugcucuggaguguucggugauaauccaccgcccaaagacggcaaggggagcugugacccugucacuguugauggagccgacggcgugaaagguuuuucauaccgauaugggaacggcguauggaucggaagaacaaagaguaauagguuccggaaaggcuuugagaugauuugggauccaaacggguggaccgacacugauuccgacuuccuggugaagcaggaugucguggcgaugacagacuggagcggauacucugguucauuuguucagcaccccgaacucaccggcuuagauugcaugcguccuuguuucuggguggagcugguccgcgggagaccaagggaaaauacgaccauauggacaaguggaagcuccaucucuuucugcggcgugaacucggacacugcaaauuggagcuggcccgauggugccgagcuuccguuuaccauugacaaauga

SEQ ID NO: 148027 - RNA, 1413 nt, Artificial Sequence
  derived and/or modified sequence opt3 from neuraminidase__InfluenzaA__BAA06715
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaauaauuacguacgaaaauucuaccugggugaaccaaacauaugucaauaucaacaauacuaacguuguggcagggaaagacaagaccucgguaacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggaugggauggcuuacgauugguaucaguggccccgacaacggggccguggcuguccugaaguauaacggaauaauuacugaaaccaucaaaucuuggaagaaacggaucuugcgcacacaggaguccgagugcguguguguaaauggcagcugcuuuacuauuaugaccgaugguccuucgaacggggccgcgucuuacagaaucuucaagauugaaaaaggaaagguuacaaaguccauagagcucgacgcaccaaauuaucauuacgaagaguguucaugcuaccccgauaccggcacggugaugugugucugcagggacaacuggcacggcaguaaucggccuagcguguccuuuaaccagaaucuggauuaucaaaucggguacauuugcucuggaguguucggugacaacccacgcccgaaagauggcgaggggagcuguaaucccgucacuguugacggagccgacggcgugaaggguuuuucauaucgauacgggaacggcguauggaucggaagaacaaaaaguaauaggcugcggaagggcuucgaaaugaucugggauccuaacggguggaccgacacugauuccgacuuuagcgugaaacaggaugucguggcuaugacagacuggucuggauauucagguaguuucguucagcacccagagcucaccggcuuagauugcaugcgucccuguuuuuggguggaacugauucgcgggagaccuagggagaagacgaccauauggacaagcggauccucuaucucguucugcggcgucaauagcgacacugccaacugguccuggccagauggugcagaacuucccuucaccauugacaaauga

SEQ ID NO: 148028 - RNA, 1410 nt, Artificial Sequence
  derived and/or modified sequence opt3 from neuraminidase__InfluenzaA__BAA06716
augaacaccaaucagagaaucauuacaauaggcacuaucugccugauuguggggaucauuagccuccuucugcaaaucggaaacauaaucuuguuauggaugucccacucuauucagacgggugagaagucacaucccaaagucuguaaucagaguguuaucaccuacgaaaacaauacaugggugaaccagacuuauguaaauauuagcaacaccaauaucgccgcuggccaaggggugacaccuauaauucuggcaggaaacuccucucuaugcccaaucucgggcugggccauuuacucaaaggacaauagcaucaggaucgguaguaaaggggauauuuucgucaugcgggagccguuuauauccuguucucaccucgaaugccgcaccuucuuucugacucagggagcgcuucugaacgaccgacauagcaauggcacagugaaggaucguucccccuauagaaccuugaugucauguccuaucggcgaggcuccaagucccuacaacagcagguucgaaucuguugccugguccgcaucagccugccacgacgggaugggauggcucacgauugguaucagcggcccugauaauggggcuguggcaguccugaaauauaacggaauaauuacugacaccaucaagaguuggcggaacaagauccugcgcacacaggagucugagugugugugcauuaauggcuccuguuuuacuaucaugaccgaugguccaagcaacgggcaggccucguacaaacucuucaagauggaaaaaggaaagauuauaaaaucuaucgaguuagacgcucccaauuaucauuacgaagagugcuccuguuacccugauacaggcaagguaguuugcgugugcagagacaacuggcacgccucaaauaggccaugggucaguuuugaucaaaaccuggacuaucagauuggcuacaucuguagcgggguguucggagauaauccgcgguccaacgacgguaagggcaauugcgggcccgugcuuucuaacggagcgaauggcgucaaagguuuuagcuuccgcuaugggaacggcguuuggaucggacgaaccaagucaauuaguuccagaaggggcuuugagaugauaugggacccuaauggguggacggaaacugauagcucuuucucaaugaaacaggacaucauugcauugacagauuggaguggauacagcgguuccuuugugcagcacccagagcugaccggcaugaacuguauccggcccugcuucuggguagaacuaauucgugggcaaccuaaggagucuacuaucuggacaucgggaagcuccauaucauucuguggcgugaauagugguaccgccucuuggagcuggccagacggggcugaucuccccuuuacgaucgacaaauga

SEQ ID NO: 148029 - RNA, 1413 nt, Artificial Sequence
  derived and/or modified sequence opt3 from neuraminidase__InfluenzaA__BAA06717
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaaugauaacguacgaaaauucuaccugggugaaccaaacauaugucaauauuucgaacacuaauguuguggcagggaaagacaagaccucaguaacacuugccggaaacagcagucuguguccuaucaggggcugggcgauuuacaccaaagauaauuccauccggaucgguucuaagggggacguguucgucauucgcgagccauuuauaagcugcucccacuuggagugucgaacuuucuuuuuaacacagggagcucugcuaaacgauaaacauucaaauggcaccgugaaggaccguaguccguauagagcccucaugagcugcccccugggcgaagcaccuucuccauacaacuccagguucgagucaguugccuggagcgcuagugcaugucacgaugggaugggauggcuuacgaucgguauuucuggccccgacgauggggccguggcuguccugaaguauaauggaaucauaacugaaaccauuaaauccuggcggaagcagaucuugcgcacacaggagagcgagugcguguguguaaacggcucgugcuuuacuaucaugaccgacgguccuucugaugggccagccuccuacagaauuuucaaaaucgaaaagggaaaaguuacaaagucaauugagcucgacgcgcccaacuaucauuacgaagaguguaguugcuacccugauaccggcacggugaugugugucugcagggacaauuggcacggcagcaaccggccauggguguccuuuaaucaaaaccuggauuaucagauaggguacaucugcucuggaguguucggugacaauccgcgccccaaggacggcgaggggagcuguaacccugucacuguugauggagcagacggcgugaaagguuuuucauaucgauacgggaauggcguauggauuggaagaacaaagaguaacaggcugcggaaaggcuucgaaaugaucugggauccaaauggguggaccgacacugauuccgacuuuagcgugaagcaggaugucguggccaugacagacuggucuggauauucagguaguuucguucagcaccccgagcucaccggcuuagauugcaugcguccuuguuuuuggguggaacugauccgcgggagaccaagggagaaaacgaccauuuggacaagcggauccucuauaucguucugcggcgucaacagcgacacugcuaauugguccuggcccgauggugccgaacuuccguucaccaucgacaaguga

SEQ ID NO: 148030 - RNA, 1413 nt, Artificial Sequence
  derived and/or modified sequence opt3 from neuraminidase__InfluenzaA__BAA06718
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccguagacucaugagcugucccauuggcgaagccccuucuccauauaauuccagguucgagucaguggcauggagcgccagugcuugccaugaugggaugggauggcugaccaucgguauaucuggccccgacgauggggcagucgccgugcuuaaauacaacggaauuaucacggaaacuaucaaguccuggcggaagcgcauucugagaacccaggagagcgaguguguaugcguuaacggcucguguuuuacaaucaugacugacgguccuaauaacgggccagcuucuuauaggauuuucaaaauagaaaagggaaaaaucaccaaguccauugaguuggaugcccccaauucacacuacgaagagugcaguuguuacccugacgcgggcacagugaugugcgucugccgggauaacuggcauggcagcaaucgcccauggguguccuuuaaccaaaaucucgacuaucagaucggguacaucuguucuggaguguucggugauaacccgcgacccaaagacggcaaggggagcugcgacccugucaccguugauggagcagacggcgugaaggguuuuucauauagauacgggaauggcguauggauuggaaggacgaaaaguaacuccagccggcguggcuucgagaugauaugggauccaaauggguggacugacacagauucuaaguuucuggugaaacaggacgucguggccaugaccgauuggucaggauauagugguagcuucguucagcaccccgaacugacuggccucgacuguaugcgcccuugcuuuuggguggaguuagucagagggaggccacgggaaaacacaaccaucuggacguccggaucuucgauuagcuucuguggcgugaauggugauaccgcuaacugguccuggcccgacggggccgagcugccguucacaaucgauaaguga

SEQ ID NO: 148031 - RNA, 1413 nt, Artificial Sequence
  derived and/or modified sequence opt3 from neuraminidase__InfluenzaA__BAA06720
augaaccccaaucagaagaucauuaccauaggcagcaucuccauggccauugggaucauuucucugauccuccaaauaggaaacaucauuucaaucugggugagucacagcauucagacagguucccagaaucauacuggcaucugcaaccagagaauaauuacguacgaaaauucuaccugggucaaccaaacauauguuaauaucaacaauacuaacgugguagcugggaaagacaagaccucggugacacuugcaggaaauucaagccuguguccuauuuugggcugggccaucuacaccaaagauaacaguaucaggauugguuccaagggggacgucuucgugauacgggagccauuuaucucuugcagccacuuagagugucgcacuuucuuucugacacagggagcgcuacucaaugauaaacauuccaacggcaccguuaaggaccgaucaccguaucguagacugaugaguugcccccuuggcgaagcuccuagcccauacaauucuagguucgaguccguggccuggucagcaagcgccugucacgaugggaugggauggcugacgauugguaucaguggccccgacgauggggcugucgcaguguugaaguauaacggaauaauuacugaaaccaucaaaucuuggaagaaacggauccuccgcacacaggaguccgagugcguauguguuaacggcagcugcuuuacuauuaugaccgacgguccuucgaauggggccgcuucuuacagaaucuucaagauugaaaaaggaaaggugacaaaguccauagagcuggaugccccaaacucacauuaugaagaguguaguugcuaccccgacaccggcacggucaugugugugugcagggauaauuggcacggcagcaaccggccuuggguguccuuuaaucagaaccuggacuaccaaaucggguauauuugcucuggagucuucggugauaauccaccgcccaaagacggcaaggggagcuguaacccuguuacuguggacggagcggauggcguaaaagguuuuucauaccgcuaugggaauggcguguggaucggacgaacaaagaguaacagauucaggaaaggcuuugagaugaucugggacccaaauggguggaccgauacugacuccgauuucagcgucaagcaggacgugguugcaaugacagauuggucuggauacucagguaguuuugugcagcaccccgaacucaccggcuuagacugcaugcggccuuguuucugggucgagcuggugcgugggcgcccaagagaaaacacgaccauuuggacaagcggauccucuauaucguucugcggcguaaauagcgauacugccaacugguccuggcccgacggugcugagcuuccguuuaccaucgauaaauga

SEQ ID NO: 148032 - RNA, 1410 nt, Artificial Sequence
  derived and/or modified sequence opt3 from neuraminidase__InfluenzaA__BAD16637
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuucuaaggacagccgcucagguuacgaaacuuuuaagguuauaggcggguggaguacaccuaauuccaaaagccaggugaacagacaagucaucgugggaaauaacaauuggucuggcuauucagguauuuucaguguagagggcaagagcugcaucaacagguguuuuuacguugagcugauccgggggaugccacaggaaacccgagugugguggacguccaauucuauugucguguucugcggaaccucgggcacauaugggacuggaagcuggcccgauggugcaaacauaaauuuuaugccgaucuga

SEQ ID NO: 148033 - RNA, 1410 nt, Artificial Sequence
  derived and/or modified sequence opt3 from neuraminidase__InfluenzaA__BAD16638
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaugaaagcgagugcgucuguauaaauggaacaugcaccguggugaugacggaugguucugcauccggccgcgcugacacuagaauccuguuuauuaaggaggggaaaaucguccacauaucaccucucagcggaagugcccagcauauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuaauaaggacucucgcagcgguuacgaaacuuuuaagguuauaggcggguggucaacaccuaacaguaaaucccaggugaauagacaggucaucguggauaacaauaacuggagcggauauucuggcauuuucucaguagaggguaagaguugcaucaauagguguuuuuacguugagcugauccgggggcgaccacaagaaacccgcgugugguggacgagcaacuccauugucguguucugcggcaccucuggaacauauggcacugggucguggcccgacggagcaaauauaaacuuuaugccgaucuga

SEQ ID NO: 148034 - RNA, 1410 nt, Artificial Sequence; identical to SEQ ID NO: 145213
  derived and/or modified sequence opt3 from neuraminidase__InfluenzaA__BAD16639

SEQ ID NO: 148035 - RNA, 1410 nt, Artificial Sequence
  derived and/or modified sequence opt3 from neuraminidase__InfluenzaA__BAD16640
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccgaggucguggaguauaggaacuggaguaaaccucagugccaaaucaccggguucgccccauuuagcaaggauaauuccauacgguuaucugcgggaggugacauuuggguuacucgcgaacccuacgugucgugugauccuggcaaaugcuaucaguucgcucuggggcagggaacaacccuagacaacaagcacucaaaugauacgauccaugaccguauuccacaccgaacucuccugaugaacgagcuuggcguccccuuucaucuggguaccagacagguguguguagccuggagcaguuccucuugccacgaugggaaggcaugguugcacguuugugugacaggagacgauaaaaaugccacugcuagcuucaucuacgacggcaggcucauggauuccaucggcucauggagucaaaacauucugcggacccaggaaagcgagugcgucuguauaaaugggacaugcaccguggugaugacggacggaucugcauccggucgcgccgauacuagaauccuguuuauugaggaaggcaagaucguccauauaucaccucucagcgggagugcucagcacguugaggaaugcucuuguuauccaagguacccggacgugcggugcauuugucgcgacaacuggaaaggauccaaucgacccguaaucgauaucaacauggaggacuauagcauugauucgucuuacgugugcuccggcuuagucggugacacaccuagaaacgaugacaggucaaguaauagcaacugucggaauccaaacaaugaacgugggaaccccggagugaagggcugggccuucgauaauggcgacgauguuuggauggggcgcaccaucuccaaagaccugagaucuggauacgagacuuuuaaggugauugguggcuggagcacaccuaacucaaagagucagauaaauaggcaagucaucguggauuccaacaauuggagcggguauucuggaauuuucucaguagagggcaaaaguugcaucaaccgguguuuuuacguugaacuuauccgaggucgccagcaggagaccagagugugguggacgagcaauuccauugucguguucugcgggaccucuggcacauauggaacuggcucguggccagacggggcgaacauaaauuuuaugcccaucuga

SEQ ID NO: 148036 - RNA, 1410 nt, Artificial Sequence
  derived and/or modified sequence opt3 from neuraminidase__InfluenzaA__BAD16641
augaaccccaaucagaagaucauuaccauaggcagcgccucccugacaaucgcuacugugugcuuccucaugcaaauugcaauccuugucacgaccguuacacugcacuuuaaacagcaugagugugacucuccugccucaaaccaggugaugccaugcgaaccgauuaucauagagagaaauacuaccgaaaucguauacuugaacaauacaaccauugagaaggaaaucugucccaaaguggucgaguauaggaacuggaguaagccucagugcaaaauuacuggguucgcgccauuuagcaaggauaauuccauccgguuaucugcuggaggugacauaugggugacacgcgagcccuacguuucgugugauccuggcaagugcuaucaauucgcccuggggcagggaaccacgcuagacaacaaacacucaaaugauacuauucaugaccgaaucccacaccguacccuccugaugaacgaacuuggcgugcccuuucaucuggguacaagacaggucuguauugcauggagcaguuccucuugccacgaugggaaggccugguugcacguguguguaacuggagacgauaaaaaugcuaccgccagcuucaucuacgacggcaggcucguugauuccaucggcucauggagucagaacauucugcggacacaagagagcgaaugcguguguauaaaugggaccugcacggucgugaugacugacggaucugcauccggucgcgcugauacaagaauccuguuuauugaggagggcaagaucgugcauauaucaccucucagcgggagugcccagcacgucgaagagugcucuuguuauccaagguacccggacguucggugcauuugucgcgacaacuggaaaggauccaaucgacccgugguagauaucaacauggaagacuauagcaucgauucgucuuacgugugcuccggcuuagucggugacaccccuagaaacgaugacaggucaaguaauagcaacugucggaauccaaacaaugagaaggggaaccagggagugaagggcugggcguucgauaauggcgacgauguuuggauggggcguacuauuuccaaagaccugcgcucuggauacgaaacauuuaaggugaucgguggcuggagcacccccaacucaaaaagucagauuaauagacaagucauaguggauuccgacaacaggagcggguauucuggaaucuucucaguagagggcaagaguugcauuaaucgguguuuuuacguugagcuuauccgaggucgcaaacaggaaacgagagugugguggaccagcaacuccaucgucguguucugcgggacaucuggcacuuauggaaccggcucguggccugacggggcaaauauuaacuugaugccaauauga

SEQ ID NO: 148037 - RNA, 1410 nt, Artificial Sequence
  derived and/or modified sequence opt3 from neuraminidase__InfluenzaA__BAD16642
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgauaaggagaaaugucccaaggucguggaauacaggaacuggaguaaaccucagugccaaauuaccggguucgccccauuuagcaaggacaauuccauccgguuaucugcgggaggugauauauggguuacucgcgagcccuaugugucgugugaccauggcaagugcuaccaguucgcucuggggcagggaacaacccuagauaacaaacacucaaaugacacgauucaugaucgaaucccucaccguacucuccugaugaacgagcuuggcgucccauuucaucuggguaccagacagguguguauugccuggagcaguuccucuugccacgacgggaaggcaugguugcacguauguaucacaggagaugacaaaaaugccacugcuagcuucaucuaugauggcaggcucguugacuccauuggcucauggagucaaaacauacugcggacccaggaaagcgagugcguguguaucaaugggacaugcaccgucgugaugacggauggaucugcauccggucgcgccgacacuaggauucuguuuaucgaagagggcaagauagugcauauuucaccccucagcgggagugcucagcacgucgaggaaugcucuuguuacccuagauauccaggaguucggugcaucugucgcgacaacuggaaaggcuccaaucgaccggugguagauaucaacauggaggacuacagcauugauucgucuuacgugugcuccgguuuagucggggacacacccagaaacgaugacaggucaaguaauagcaacugucggaauccuaacaaugaacguggaaaccagggcgugaagggcugggccuucgauaauggggacgauguuuggaugggacgcaccaucuccaaggaccugagaucugguuaugagacuuuuaaagugauuggcggguggagcacaccaaacucaaagagucaaauaaauaggcaggucaucguggauuccgacaaccggagcggauacucuggcauuuucucaguagaagguaaaaguugcaucaaucgauguuuuuauguugagcuuauccgcgggagaaagcaggagaccagggugugguggacgagcaacuccauugucguguucugcggcaccucuggaacauacggcacugggucguggcccgacggagcgaauauaaacuuuaugccuaucuga

SEQ ID NO: 148038 - RNA, 1410 nt, Artificial Sequence
  derived and/or modified sequence opt3 from neuraminidase__InfluenzaA__BAD16643
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaacaaugauagauccucaaacaguuacuguaggaauccaaacaaugaaaaaggaaaccacggcgugaagggcugggccuucgacgaugggaaugacguuuggaugggacggacaaucagcgaggauucccguucugguuaugaaaccuuuaaagugauuggcgggcuuuucacgcccaacagcaaguugcagauaaaucgccaggucaucguggacucagauaacagaaguggauacuccggcauuuuuagcguagaggguaaaucuugcaucaauagguguuucuauguugagcugauccgggggcgagaacaagagacccgcgugugguggacaucaaacaguauugucguguuuugcggcacuagcggaaccuacggcacaggguccuggccugacggagcggauauaaaucuaaugccaaucuga

SEQ ID NO: 148039 - RNA, 1410 nt, Artificial Sequence
  derived and/or modified sequence opt3 from neuraminidase__InfluenzaA__BAD16644
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugaugccgugcgaacccaucauaaucgagagaaacauuacugaaaucguauauuugaccaauacaaccauugagaaggaaaucuguccuaaauuaguggaguacaggaacuggucaaagccacagugcaaaauaacuggguucgcacccuuuaguaaggauaauagcauucggcuguccgccggaggugacaucugggucacacgcgagccuuaugugucuugugauccaggcaagugcuaccaauucgcgcuagggcagggaaccacgcucgacaacaaacauucgaaugauacuauucacgaccgaacaccccaucguacccugcuuaugaacgaacugggcguuccuuuucacuuggguacuagacagguguguaucgcuuggucaaggagcaguugccaugaugggaaggccuggcuccacgucugugugaccggauaugacaaaaaugcaacagccuccuucaucuacgauggccggcugguagacucuauuggcagcugguccaagaacauacugcgcacccaggagucagaaugcguuuguaucaaugggacgugcacuguggucaugacagauggaagugcuagcgguagagcagacaccaaaauucucuuuaucgaggagggcaagauagugcacauuucuccauuauccgggucagcccaacauguggaagagugcagcuguuauccgagguaccccggaguccggugcaucugucgcgauaacuggaagggcaguaaucgaccuguuguggacaucaacguaaaagacuacucuauugauuccagcuaugugugcucgggucuggucggggacacuccaagaaacaaugauaggucuuccaacucauacugucggaaucccaacaaugaaaagggaaaccacggcgugaaaggcugggcuuucgacgaugggaaugacguuuggaugggacguacaaucagugaggauagccgcuccgguugcgaaaccuuuaaggugauuggcggguggucuacgccuaacagcaaacuucagauaaauagacaggucaucguggacucagauaacaggaguggauauuccggcauuuucagcguagaggguaagucuuguaucaaucggugcuuuuacguugaguugauccgagggcgcgaacaggagaccagagugugguggacaucaaacaguauugucguguucuguggcacuagcggaaccuauggcacaggguccuggccagacggagccgauauaaaucugaugcccaucuga

SEQ ID NO: 148040 - RNA, 1410 nt, Artificial Sequence; identical to SEQ ID NO: 136592
  derived and/or modified sequence opt3 from neuraminidase__InfluenzaA__BAD16645

SEQ ID NO: 148041 - RNA, 1410 nt, Artificial Sequence; identical to SEQ ID NO: 144560
  derived and/or modified sequence opt3 from neuraminidase__InfluenzaA__BAD16646

SEQ ID NO: 148042 - RNA, 1410 nt, Artificial Sequence; identical to SEQ ID NO: 136592
  derived and/or modified sequence opt3 from neuraminidase__InfluenzaA__BAD16647

SEQ ID NO: 148043 - RNA, 1410 nt, Artificial Sequence
  derived and/or modified sequence opt3 from neuraminidase__InfluenzaA__BAD16648
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggauacgauaaaaaugcaacagccagcuucaucuaugacggcaggcugguagauuccauuggcucauggaguaagaacauacugcggacccaggagagcgaaugcguuuguaucuacgggacgugcacuguggucaugacagacggaucugcuuccgagcgcgcagagaccaaaauucucuuuaucgaagaggguaagauagugcacauuucaccauuaagcggcagugcccaacacguggaagagugcucuuguuacccgagauaucccggggucaggugcguuugucgggauaauuggaagggauccaaccgcccugugguagacaucaaugugaaagauuacagcaucgucucgucuuaugugugcuccggccugguuggugacacuccacgaaagaacgacagaucaaguagcuccuacuguaggaaccccaauaacgaaaaagggaaucauggagugaagggcugggcuuucgaugacggcaacgaugucuggauggggcggacaauuucugaggagagccguucaggauaugaaaccuuuaaagugaucgguggcuggaguacgccuaauuccaaacuucagauuaaccgccagguaauaguugacagcgauaauagaucuggguacucaggaaucuucaguguggagggcaagagcugcauuaacagguguuuuuaugucgaauugauccggggucgagagcaggaaacccgcgugugguggacauccaauucuaucgucguguucugcgggacuucgggcaccuacggaacaggcagcuggccagacggggccgauauuaaccugaugcccauauga

SEQ ID NO: 148044 - RNA, 1410 nt, Artificial Sequence
  derived and/or modified sequence opt3 from neuraminidase__InfluenzaA__BAE07203
augaaccccaaucagaagaucaccacaauuggcagcauaugcauggugaucgggauugucucccugaugcuccaaaucggaaacauuaucucuauauggguuucacacaguauccagacugguaaucagcaucaggccgagccuuguaaccaaagcauuaucacguacgaaaauaacaccugggugaaucagacauauguaaacauuuccaauacuaacuuccuuaccgagaaagcuguggcaucugucacacuggccggcaauucgucauugugcccaaucagcgggugggcgguguacaguaaggacaacggaauaagaauuggcuccaaaggugauguuuuugugaucagggaaccguucauuucuuguagccacuuagagugccggaccuuuuuccugacucagggggcucuacucaaugacaagcauuccaacggaacagucaaagaucgcucaccccaccgaacccugaugaguuguccugugggcgaagccccaagccccuauaauucucguuuugaguccguagcauggucagccagcgcuugccaugacggcacgaguuggcuuacuaucgggaucucuggaccugauaacggugcaguugccgugcugaaguacaacggcauuauaaccgacacaaucaaguccuggagaaauaacauuaugaggacucaggagagcgaaugugcuugcgucaaugggucguguuucaccgugaugacagauggaccaucuaacggccaagccuccuauaaaaucuuucggauagagaaggguaaaguggucaagucagcggaauugaaugcacccaacuaccacuaugaggagugcaguuguuacccugacgccggggaaauuaccugcguuugccgcgauaauuggcacggaagcaacagaccauggguguccuucaaucagaaccucgaguacaggaucggcuauaucuguucuggcguauuuggggacaauccgcggcccaacgauggaacggguagcugcggcccugugucaccaaaaggggcuuacggaauuaagggcuucaguuuuaaguaugguaauggggucuggaucggccgcacuaaauccacaaacagccgaucuggauucgaaaugauuugggaccccaauggcuggaccgggacugauucaaacuuuagugugaagcaggacauaguugccaucacagacuggagcggauacuccgguucuuucgugcagcauccugagcugaccggccuggauuguauuagaccaugcuucugggucgaacucaucagggggcggcccaaagagucgacgaucuggaccagcggauccucaauuaguuuuuguggcgugaacucugacacaguagguuggagcuggccggauggggcagaguuaccuuucacuauagacaaguga

SEQ ID NO: 148045 - RNA, 1410 nt, Artificial Sequence
  derived and/or modified sequence opt3 from neuraminidase__InfluenzaA__BAF46322
augaaccccaauccuaagaucauuaccauaggcagcgugucccugacaaucucuacuauuugcuucuuuaugcagaucgccauucucaucacgaccgucacacuucacuucaaacaauacgaguuuaacucaccaccgaauaaccagguuaugcugugugaacccacuauaaucgagagaaauauuaccgaaaucguguauuugacaaacaccacuauugagaaggaaaucugcccuaaauuagcugaguacaggaauuggaguaagccacagugugacauaacaggguucgcacccuuuagcaaagauaacuccauucggcugucugccggaggugacaucuggguaacccgcgagccuuaugugucgugcgauccagacaaguguuaccaguucgcgcuaggccaagggacgacucucaauaacguccauucaaaugauaccgugcacgaccgaacacccuaucguacucugcuuaugaacgaacugggaguuccuuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccagcacgucgaagagugcucuugcuauccacgguacccgggcguucgcugugugugcagagauaacuggaaaggguccaacaggcccauaguagacauuaauaucaaggacuacagcaucgugucgucuuaugucuguuccggacuggugggcgauacgccucggaaaaacgacucaaguagcuccucucauugccuugauccaaauaacgaagagggugggcacggaguuaagggcugggcuuucgacgauggcaaugacguguggauggggcgcaccauuagcgaaaaauugcgaucaggauacgagacauuuaaggucaucgaggguuggaguaaccccaauuccaaacugcaaauuaacagacaggugauaguagauaggggcaaucggagcggguauucuggaaucuucucaguugaaggcaagaguuguauuaaccguugcuuuuacguggagcuaauccgcgguagaaaggaagagacugaaguccucuggaccagcaauuccaucguggucuucugugggacaucuggcacuuauggaaccggcucguggccugacggggccgauauuaaccugaugccaauauga

SEQ ID NO: 148046 - RNA, 1410 nt, Artificial Sequence; identical to SEQ ID NO: 136730
  derived and/or modified sequence opt3 from neuraminidase__InfluenzaA__BAF46323

SEQ ID NO: 148047 - RNA, 1410 nt, Artificial Sequence
  derived and/or modified sequence opt3 from neuraminidase__InfluenzaA__BAF46324
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauauugugcacgaccgaaccccauaucguacacugcuuaugaacgaacugggaguucccuuucauuugggcacuaaacaggugugcaucgcuuggagcaguuccucuugucacgaugguaaggccuggcuccaugucugggugaccggggacgauaagaaugcaacagccagcuucaucuacaacggaagacugguagacuccauuguuucauggaguaaaaagauacugaggacccaggagagcgaaugcguguguaucaauggcacgugcacugucgugaugacagauggcucugcuuccgggaaagcagacaccaagauucucuuuaucgaggagggaaagauagugcacacuucaacauuaagcgguagugcccaacacgucgaagaguguucuugcuauccucgguacccaggcguucgcugcguguguagagauaacuggaaaggguccaacaggccgauuguagacaucaauaucaaggacuacagcauugugucgucuuaugucugcuccggacuggugggcgauacgccccggaaaaacgacucaaguagcuccucucauugucuugauccuaauaacgaagagggugggcacggaguuaagggcugggcuuucgacgauggcaaugacguguggauggggcgcaccaucagcgaaaaauugcgaucaggauacgagaccuuuaaggucauugaggguuggaguaacccaaauuccaaacugcagauaaacagacaggugaucguagauaggggcaaucggagcggguauucuggaauuuucucaguugaaggcaagaguugcaucaaccguuguuuuuacguggagcuaauccgcgguagaaaggaagagacagaaguccucuggacuagcaauuccauuguggucuucugcgggaccucuggcacauauggaacuggcucguggcccgacggggccgauauaaaccugaugccuaucuga

SEQ ID NO: 148048 - RNA, 1410 nt, Artificial Sequence
  derived and/or modified sequence opt3 from neuraminidase__InfluenzaA__BAF46332
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaccacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggacuggugggcgacacgccccgcaaaaacgauucaaguagcuccucucauugccuugacccuaauaacgaggaaggugggcacggaguuaagggcugggcuuucgaugacggcaaugauguguggauggggcgaaccauuagcgagaaauugagaucaggauacgagacauuuaaggucaucgaagguuggaguaacccaaauuccaaacugcaaauuaacaggcaagugauaguagaccggggcaaucguagcggguauucuggaaucuucucaguugagggcaagaguuguauuaaccgcugcuuuuacguggaacuaaucagagguaggaaggaggaaacugagguccucuggaccagcaauuccaucguggucuucugugggacaucuggcacuuauggaaccggcucguggcccgauggggccgacauuaaccugaugccuauauga

SEQ ID NO: 148049 - RNA, 1410 nt, Artificial Sequence
  derived and/or modified sequence opt3 from neuraminidase__InfluenzaA__BAF46334
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggacuggugggcgacacgccccgcaaaaacgauucaaguagcuccucucacugccuugacccuaauaacgaggaaggugggcauggaguuaagggcugggcuuucgaugacggcaaugauguguggauggggcgaaccauuagcgagaaauugagaucaggauacgagacauuuaaggucaucgaagguuggaguaacccaaauuccaaacugcagauuaacaggcaagugauaguagaccggggcaaucguagcggguauucuggaaucuucucaguugagggcaagaguuguauuaaccgcugcuuuuacguggaacuaaucagagguaggaaggaggaaacugagguccucuggaccagcaauuccaucguggucuucugugggacaucuggcacuuauggaaccggcucguggcccgauggggccgacauuaaccugaugccuauauga

SEQ ID NO: 148050 - RNA, 1410 nt, Artificial Sequence; identical to SEQ ID NO: 148049
  derived and/or modified sequence opt3 from neuraminidase__InfluenzaA__BAF46335

SEQ ID NO: 148051 - RNA, 1410 nt, Artificial Sequence
  derived and/or modified sequence opt3 from neuraminidase__InfluenzaA__BAF46337
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgaguucguacaccauauagaacucugcuuaugaacgaacugggagugcccuuucacuugggcaccaaacaggucugcauugcuuggagcaguuccucuugucaugaugguaaggccuggcuccacgugugcguaacaggggacgauaaaaaugcaaccgccagcuucaucuacaacggaaggcugguugacuccaucgugucauggaguaaggagauucugcggacgcaggaaagcgagugugucugcauaaauggcacuuguacaguggugaugaccgauggcucugcuuccgggaaagcagacacuaagauccucuuuauugaggaaggaaagaucguccauacaucaaccuuaagcgguagugcccaacacguugaggaaugcucuugcuauccucgcuacccaggcgugagauguguaugcagggauaacuggaaaggguccaaccggccgauaguggacauuaauaucaaggauuacagcaucgucucgucuuauguguguuccggacugguuggcgacacgccccgcaaaaacgacucaaguagcuccucucacugccuugauccuaauaacgaggaaggugggcauggagugaagggcugggcuuucgacgauggcaaugacgucuggauggcccgaaccauuagcgagaaauugagaucaggguacgagacauuuaaggugaucgaaggauggaguaacccaaauuccaaacugcagauuaacaggcagguaauaguugaucgggguaaucguagcggcuauucugggaucuucucaguggagggaaagaguuguauuaaccgcugcuuuuacgucgaacuaaucagaggcaggaaggaggaaacugaggugcucuggaccagcaauuccaucgucguguucugugguacaucugggacuuauggcaccggaucguggcccgacggcgcggauauuaaccugaugccuauauga

SEQ ID NO: 148052 - RNA, 1410 nt, Artificial Sequence; identical to SEQ ID NO: 148049
  derived and/or modified sequence opt3 from neuraminidase__InfluenzaA__BAF46345

SEQ ID NO: 148053 - RNA, 1410 nt, Artificial Sequence
  derived and/or modified sequence opt3 from neuraminidase__InfluenzaA__BAF46346
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauagcaggguucgccccauuuagcaaggacaacuccauucggcugucugcgggaggugauaucuggguaacacgcgagcccuaugugucgugcgacccugauaaguguuaccaauucgcucuaggccaggggaccacgcucaauaacguccauucaaaugacacugugcgagaucguaccccauauagaacacugcuuaugaacgaacugggaguucccuuucacuugggcacuaaacaggugugcauugccuggagcaguuccucuugucaugacgguaaggcauggcuccacgucugcgugaccggggaugacaaaaaugccacagcuagcuucaucuacaacggaaggcugguagauuccaucguuucauggaguaaggagauucugcggacccaggaaagcgagugugugugcauaaauggcacguguacugucgugaugacagacggcucugcauccgggaaagccgauaccaagauccucuuuauugaggaaggaaagaucgugcauacuucaacauuaagcgguagugcucaacacgucgaggaaugcucuugcuauccucgcuacccaggcguuauaugugugugcagagacaacuggaaaggguccaacaggccgauuguagauaucaauaucaaggacuacagcauugugucgucuuaugucuguuccggacuggugggcgacacgccccggaaaaacgauucaaguagcuccucucacugccuugacccuaauaacgaggaaggugggcauggaguuaagggcugggccuucgaugacggcaaugauguguggauggggcgcaccaucagcgagaaauugcgaucaggauacgagaccuuuaaggucauugaagguuggaguaacccaaauuccaaacugcagauaaacagacaggugaucguagacaggggcaaucggagcggguauucuggaauuuucucaguugagggcaagaguuguaucaaccguugcuuuuacguggaacuaauccgcgguagaaaggaggaaacagagguccucuggacuagcaauuccauuguggucuucugugggaccucuggcacauauggaacuggcucguggcccgauggggcggacauaaaccugaugccuaucuga

SEQ ID NO: 148054 - RNA, 1410 nt, Artificial Sequence
  derived and/or modified sequence opt3 from neuraminidase__InfluenzaA__BAF46347
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccacguucaucuacaacggaaggcugguagauagcaucguuuccuggucaaaggagauucugcggacucaggaaagugagugugugugcauaaauggcacauguaccgucgugaugacugacggcagcgcuucugggaaagcagauacaaagauccucuuuauugaggaaggaaagaucgugcauaccuccacguuaucagguagcgcccaacacgucgaggaaugcaguugcuauccucgcuacccaggcguuagaugugugugcagggacaacuggaaagggucuaaccggccgauaguagauauuaauaucaaggacuacuccaucgugagcucguaugucuguucuggacuggugggcgacacccccaggaaaaacgauuccucaaguagcucccacugccuugacccuaauaacgaggaaggugggcauggaguuaagggcugggcuuucgaugacggcaaugauguguggauggggcgaacaauuucugagaaauugagaagcggauacgagacuuuuaaggucaucgaagguuggucaaacccaaauaguaaacugcagauuaaccgccaggugauaguagaccggggcaaucguuccggguauagcggaaucuucucuguugagggcaagucauguauuaaccgcugcuuuuacguggaacuaaucagagguaggaaggaggaaaccgagguccucuggacaaguaauagcaucguggucuucugugggacuuccggcaccuauggaacaggcucuuggcccgauggggccgacauuaaccugaugccuauauga

SEQ ID NO: 148055 - RNA, 1410 nt, Artificial Sequence
  derived and/or modified sequence opt3 from neuraminidase__InfluenzaA__BAF46349
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagcucguacaccauauagaacucugcuuaugaacgaacugggaguucccuuucacuugggcaccaaacaggugugcauugccuggagcaguuccucuugucaugaugguaaggcauggcuccacgucugcgugacaggggacgauaaaaaugccaccgcuagcuucaucuacaacggaaggcugguagacuccaucguuucauggaguaaggagauucugcggacgcaggaaagcgagugugugugcauaaauggcacuuguacagucgugaugaccgauggcucugcauccgggaaagccgacacuaagauccucuuuauugaggaaggaaagaucgugcauacaucaaccuuaagcgguagugcucaacacgucgaggaaugcucuugcuauccucgcuacccaggcguuagaugugugugcagggauaacuggaaaggguccaaccggccgauaguagacauuaauaucaaggauuacagcaucgugucgucuuaugucuguuccggacuggugggcgacacgccccgcaaaaacgacucaaguagcuccucucacugccuugauccuaauaacgaggaaggugggcauggaguuaagggcugggccuucgacgauggcaaugacguguggauggggcgaaccauuagcgagaaauugagaucaggauacgagacauuuaaggucuucgaagguuggaguaacccaaauuccaaacugcagaucaacaggcaagugauuguagaucggggcaaucguagcggguauucuggaauauuuucaguugagggcaagaguuguaucaaccgcugcuucuacguggaacuaauuagagguaggaaggaggaaacugagguccucuggaccagcaauuccaucguggucuucugugggacaucuggcacuuauggaaccggcucguggcccgacggggcggauaucaaccugaugccuauuuga

SEQ ID NO: 148056 - RNA, 1410 nt, Artificial Sequence; identical to SEQ ID NO: 148049
  derived and/or modified sequence opt3 from neuraminidase__InfluenzaA__BAF46350

SEQ ID NO: 148057 - RNA, 1410 nt, Artificial Sequence
  derived and/or modified sequence opt3 from neuraminidase__InfluenzaA__BAF46351
augaaccccauccagaagauuauaaccaucggcagcgugucccugacaauuucuacuaucugcuucuuuaugcagauugccauccucauaacgaccgucacacuucacuucaaacaguacgaguuuaauucaccuccaaacaaucagguuaugcugugugaaccgacuaucauugagagaaacaucaccgaaauuguguauuugacaaauaccacuaucgagaaggaaauaugccccaaauuagcugaguacaggaaguggaguaaaccucaguguaacauuacaggguucgcaccauuuagcaaggacaauuccauccggcugucugccggaggugauauuuggguaacccgcgagcccuaugugucgugcgacccugauaaguguuaccaauucgcgcuaggccaggggacgacucucaacaauguccauucaaacgacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcgugacaggggaugacaaaaacgcaaccgccagcuucaucuacaauggaaggcugguagauuccauuguuucauggaguaaggagauacugcggacgcaggaaagcgagugugugugcaucaacggcacuuguacagucgugaugaccgacggcucugcuuccgggaaagcagauacuaagauucucuuuaucgaggaaggaaagauagugcauacaucaaccuuaagcgguagugcccaacacgucgaggaaugcucuugcuauccucgcuacccaggcguuagaugugugugcagggacaauuggaaaggguccaaccggccgaugguagauauuaacaucaaggacuacagcaucgugucgucuuaugucuguuccggacuggugggcgacacgccccgcaaaaaugauucaaguagcuccucucacugccuugacccuaacaaugaggaaggugggcauggaguuaagggcugggcuuucgaugacggcaacgauguguggauggggcgaaccauuagcgagaaauugagaucaggauacgagacauuuaaggucaucgaagguuggaguaauccaaacuccaaacugcagauuaauaggcaagugauaguagaccggggcaaccguagcggguauucuggaaucuucucaguugagggcaagaguuguauuaaucgcugcuuuuacguggaacuaaucagagguaggaaggaggaaacugagguccucuggaccagcaacuccaucguggucuucugugggacaucuggcacuuauggaaccggcucguggcccgauggggccgacauuaaucugaugccuauauga

SEQ ID NO: 148058 - RNA, 1410 nt, Artificial Sequence
  derived and/or modified sequence opt3 from neuraminidase__InfluenzaA__BAF46368
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcgagaacguacaccauauagaacucugcuuaugaaugagcugggaguucccuuucacuugggcaccaaacaggugugcauugcuuggagcaguuccucuugucaugaugguaaggccuggcuccacgucugcgugacaggggacgauaagaacgcaaccgccagcuucaucuacaauggaaggcugguagacuccaucguuucauggaguaaagaaauucugcggacgcaggagagcgagugugugugcauaaacggcacuuguacagucgugaugaccgauggcucugcuuccgggaaggcagacacuaaaauccucuuuauugaagagggaaagaucgugcauacaucaaccuuaagcgguagugcccaacacgucgaagagugcucuugcuauccucgcuacccaggcguuagaugugugugcagggauaacuggaagggguccaaucggccgauaguagacauuaacaucaaagauuacagcaucgugucgucuuaugucuguuccggacuggugggcgacacgccccgcaagaaugacucaaguagcuccucucacugccuugauccuaacaaugaagagggugggcauggaguuaaaggcugggcuuucgacgauggcaacgacguguggauggggcgaaccauuagcgagaaguugagaucaggauacgaaacauuuaaagucaucgaggguuggaguaauccaaacuccaagcugcagauuaauaggcaagugauaguagaucggggcaaccguagcggguauucuggaaucuucucaguugaaggcaaaaguuguauuaaucgcugcuuuuacguggagcuaaucagagguaggaaggaagagacugagguccucuggaccagcaacuccaucguggucuucugugggacaucuggcacuuauggaaccggcucguggcccgacggggccgauauuaaucugaugccuauauga

SEQ ID NO: 148059 - RNA, 1410 nt, Artificial Sequence
  derived and/or modified sequence opt3 from neuraminidase__InfluenzaA__BAF46369
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaaaacugguagauuccaucguuucauggaguaaggagauucugagaacgcaggaaagcgagugugugugcauaaacggcacuuguacagucgugaugaccgacggcucugcuuccgggaaagcagauacuaagauccucuuuauugaggaaggaaagaucgugcacacaucaaccuuaagcgguagugcccaacacgucgaggaaugcucuugcuauccuagguacccaggcguucggugugugugccgcgacaacuggaaaggguccaauagaccgauaguagauauuaacaucaaggacuacagcaucgugucgucuuaugucuguuccggacuggugggcgacacgcccaggaaaaaugauucaaguagcuccucucauugccuugacccuaacaaugaggaaggugggcacggaguuaagggcugggcuuucgaugacggcaacgauguguggauggggcggaccauuagcgagaaaucacgcaguggauacgagacauuucaggucaucgaagguugguccaauagcaacucuaaguugcagauuaaucgacaggugauaguagacagaggcaacaggucaggguauaguggaaucuucagcguugagggcaaauccuguauuaaucggugcuuuuacguggaacugauccguggucgcaaggaggaaacugagguccuauggaccucuaacucgaucguggucuucugugggacaagcggcacuuauggaaccggcuccuggccagauggggccgacauuaaucucaugcccauauga

SEQ ID NO: 148060 - RNA, 1410 nt, Artificial Sequence
  derived and/or modified sequence opt3 from neuraminidase__InfluenzaA__BAF46370
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacuggcugaguacaggaauuggaguaagccccaguguaacauaacaggguucgcaccuuuuagcaaagacaauuccauucggcuaucugccggaggugauaucuggguaacccgcgagccauaugugucgugcgaccccgauaaguguuaccaauucgcgcucggccaggggacgacucugaacaauguccauucaaacgacaccgugcacgaucgaacaccuuaucguacucuucugaugaaugaauugggaguuccauuucaucucggcaccaaacaggugugcauugcuuggagcaguuccucuugucacgacgguaaggccuggcugcaugucugcgugacaggggaugacaagaacgcaaccgccagcuucaucuacaauggaagacugguagauuccaucguuucauggaguaaagagauucucaggacgcaggaaagcgagugugugugcauaaacggcacuuguacagucgugaugaccgacggcucugcuuccgggaaggcagauacuaaaaucuuauuuauugaggaaggaaagaucgugcacacaucaacccugagcgguagugcccaacacgucgaggaaugcucuugcuauccccgguacccuggcguucgcugugugugcagagacaacuggaagggguccaauaggccaauaguagauauuaacaucaaagacuacagcaucgugucgucuuaugucuguuccggacuugugggcgacacgccgcggaagaaugauucaaguagcuccucucauugcuuggaccccaacaaugaggaaggugggcacggaguuaaaggcugggcuuucgaugacggcaacgauguguggauggggcgcaccauuagcgagaagcugcgaucaggauacgagacauuuaaagucaucgaagguuggaguaauccuaacuccaagcuacagauuaauagacaggugauaguagacaggggcaaccggagcggguauucuggaaucuucucaguugagggcaaaaguuguauuaaucguugcuuuuacguggaacucauccgcgguagaaaggaggaaacugagguccuguggaccagcacauccaucguggucuucugugggucuucgggcacuuauggaaccggcagcuggccagauggggccgacauuaaccuuaugcccauauga

SEQ ID NO: 148061 - RNA, 1410 nt, Artificial Sequence
  derived and/or modified sequence opt3 from neuraminidase__InfluenzaA__BAF46371
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucgugcauuugacaaacaccacuauugagaaggaaaucugccccaaauuagcugaguauaggaauuggaguaagccucaguguaacauaacaggguucgcaccauuuagcaaagacaauuccauucggcugucugccggaggugauaucuggguaacccgcgagcccuacgugucgugcgacccugauaaguguuaucaauucgcgcuaggccaggggacgacucucaacaauguccacucaaacgacaccgugcaugaucgaacaccauaccguacucugcuuaugaaugaacugggaguucccuuucacuugggcaccaaacaggugugcauugcuuggagcaguuccucuugucaugacgguaaggccuggcuccacgucugcgugacaggggaugacaagaacgcaaccgccagcuucaucuauaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacaugucgaggaaugcucuugcuacccucgguauccaggcguucgcugugugugcagagacaacuggaagggguccaauaggccgauaguagauauuaacaucaaagacuacagcaucgugucgucuuacgucuguuccggacuggugggcgacacgccccggaagaaugauucaaguagcuccucucacugccuugacccuaacaaugaggaaggugggcauggaguuaaaggcugggcuuucgaugacggcaacgauguguggauggggcgcaccauuagcgagaaguugcgaucaggauaugagacauuuaaagucaucgaagguuggaguaauccaaacuccaagcugcagacuaauagacaggugauuguagacaggagcaaccggucuggcuacucagggauauucaguguugagggaaaaagcuguaucaaucguugcuuuuauguggaacuaauucgcggcagaaaggaggaaaccgagguccucuggacauccaacucuaucguggucuucugugguacuucggggaccuacggcacaggaagcuggcccgauggcgccgacaucaaucugaugccuauuuga

SEQ ID NO: 148062 - RNA, 1410 nt, Artificial Sequence
  derived and/or modified sequence opt3 from neuraminidase__InfluenzaA__BAF46372
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauagcaggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcacgaccgaaccccauaucguacacugcuuaugaacgaacugggaguucccuuucauuugggcacuaaacaggugugcauugccuggagcaguuccucuugucacgaugguaaggcauggcuccaugucugcgugaccggggacgauaagaaugccacagcuagcuucaucuacaacggaagacugguagacuccaucguuucauggaguaaaaagauucugaggacccaggagagcgaaugugugugcauaaauggcacguguacugucgugaugacagauggcucugcauccgggaaagccgacaccaagauccucuuuauugaggagggaaagaucgugcacacuucaacauuaagcgguagugcucaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggccuucgacgauggcaaugacguguggauggggcgcaccauuagcgaaaaauugcgaucaggauacgagaccuuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacagaaguccucuggacuagcaauuccaucguggucuucugugggaccucuggcacauauggaacuggcucguggcccgacggggcggauauuaaccugaugccuauauga

SEQ ID NO: 148063 - RNA, 1410 nt, Artificial Sequence
  derived and/or modified sequence opt3 from neuraminidase__InfluenzaA__BAF46385
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuuguccugacgguaaggccuggcuccacgucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccacgguacccgggcgcucgcuguguuugcagagacaacuggaagggguccaauaggcccauaguggauauuaacaucaaagacuacagcaucguaucgucuuauguguguuccggacuggucggcgacacgccucggaagaaugauucaaguagcuccucucacugccuugacccaaacaaugaggaaggugggcauggagugaaaggcugggccuucgaugacggcaacgauguuuggauggggcgcaccauuagcgagaaguugcgaucaggauacgagacauuuaaagugaucgaagguuggaguaaucccaacuccaagcugcagacuaauagacaggucauuguggacaggggcaaccggagcggguauucuggaauauucucaguagagggcaaaaguuguaucaaucguugcuuuuacguugaacuaauucgcgguagaaaggaggaaaccgaggugcucuggacaagcaacuccaucgucguguucugugggacuucuucgaccuauggcacaggaagcuggccugauggcgcggacaucaaucugaugccaauuuga

SEQ ID NO: 148064 - RNA, 1410 nt, Artificial Sequence
  derived and/or modified sequence opt3 from neuraminidase__InfluenzaA__BAF46386
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagacuaauagacaggugauuguagacaggggcaaccggagcggguauucuggaauauucucaguugagggcaaaaguuguaucaaucguugcuuuuacguggaacuaauucgcgguagaaaggaggaaaccgagguccucuggacaagcaacuccaucguggucuucugugggacuucuucgaccuauggcacaggaagcuggcccgauggcgccgacaucaaucugaugccuauuuga

SEQ ID NO: 148065 - RNA, 1410 nt, Artificial Sequence; identical to SEQ ID NO: 138580
  derived and/or modified sequence opt3 from neuraminidase__InfluenzaA__BAF46387

SEQ ID NO: 148066 - RNA, 1410 nt, Artificial Sequence
  derived and/or modified sequence opt3 from neuraminidase__InfluenzaA__BAF46388
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggacauaguggauaggggcaaccggagcggguauucuggaaucuucucaguagagggcaaaaguuguauuaaucguugcuuuuacguugaacuaauccgcgguagaaaggaggaaaacgaggugcucuggacuagcaauuccaucgucguguucugugggaccucuggcacauauggaacuggcucguggcccgacggggccgauauuaaccugaugccuauauga

SEQ ID NO: 148067 - RNA, 1410 nt, Artificial Sequence
  derived and/or modified sequence opt3 from neuraminidase__InfluenzaA__BAF47922
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauauacagguuaugcugugugaaccgacuaucauugagagaaacaucaccgaaauuguguauuugacaaauaccacuaucgagaaggaaauaugccccaaauuagcugaguacaggaacuggaguaagccucagugugacauuacaggguucgcaccauuuagcaaagauaauuccauccggcugucugccggaggugacauuuggguaacccgcgagcccuaugugucgugcgauccugacaaguguuaccaauucgcgcuaggccaggggacgacucucaacaauguccauucaaacgauaccgugcacgaccgaacaccauaucguacucugcuuaugaaugaacugggaguucccuuucauuugggcaccaaacaggugugcaucgcuuggagcaguuccucuugucacgaugguaaggccuggcuccaugucugcgugacaggggacgauaagaacgcaaccgccagcuucaucuacaauggaagacugguagacuccauuguuucauggaguaaagagauacugaggacgcaggaaagcgagugugugugcaucaacggcacuuguacagucgugaugaccgauggcucugcuuccgggaaggcagacacuaaaauucucuuuaucgaggaaggaaagauagugcacacaucaaccuuaagcgguagugcccaacacgucgaggaaugcucuugcuauccucgguacccaggcguucgcugugugugcagagauaauuggaagggguccaacaggccgauuguagacaucaacaucaaagacuacagcauugcuucgucuuauguguguuccggacuggucggcgauacgccccggaagaaugacucaaguagcuccucucauugccuugauccuaacaaugaggaaggugggcacggagugaaaggcugggccuucgacgauggcaacgacguuuggauggggcgcaccaucagcgagaaguugcgaucaggauacgagacauuuaaagugauugaagguuggaguaauccaaacuccaagcugcagauaaauagacaggucaucguggauaggggcaaccggagcggguauucuggaauuuucucaguagagggcaaaaguuguaucaaucguugcuuuuacguugaacuaauccgcgguagaaaggaggaaacugaggugcucuggaccagcaacuccauugucguguucugugggacaucuggcacuuauggaaccggcucguggcccgacggggcggauauaaaucugaugccuaucuga

SEQ ID NO: 148068 - RNA, 1410 nt, Artificial Sequence; identical to SEQ ID NO: 136710
  derived and/or modified sequence opt3 from neuraminidase__InfluenzaA__BAF47923

SEQ ID NO: 148069 - RNA, 1410 nt, Artificial Sequence
  derived and/or modified sequence opt3 from neuraminidase__InfluenzaA__BAF47924
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacagcgaggaaggugggcacggaguuaaaggcugggcuuucgaugacggcaaugauguguggauggggcgcaccauuucagagaaguugcgaaguggauacgagacauuuaaagucaucgaagguugguccaacccaaauagcaagcugcagacuaacagacaggugauuguagacaggggcaaucggucuggguauucaggaauauucaguguugagggcaaaagcuguaucaaccguugcuuuuacguggaacuaauucgcgguagaaaggaggaaaccgagguccucuggacauccaauucuaucguggucuucugugggacuucgggcaccuauggaacaggcagcuggcccgauggggccgacaucaaccugaugccuauuuga

SEQ ID NO: 148070 - RNA, 1410 nt, Artificial Sequence; identical to SEQ ID NO: 136728
  derived and/or modified sequence opt3 from neuraminidase__InfluenzaA__BAF47925

SEQ ID NO: 148071 - RNA, 1410 nt, Artificial Sequence; identical to SEQ ID NO: 136728
  derived and/or modified sequence opt3 from neuraminidase__InfluenzaA__BAF47926

SEQ ID NO: 148072 - RNA, 1410 nt, Artificial Sequence; identical to SEQ ID NO: 142715
  derived and/or modified sequence opt3 from neuraminidase__InfluenzaA__BAF47927

SEQ ID NO: 148073 - RNA, 1410 nt, Artificial Sequence; identical to SEQ ID NO: 138580
  derived and/or modified sequence opt3 from neuraminidase__InfluenzaA__BAF47928

SEQ ID NO: 148074 - RNA, 1410 nt, Artificial Sequence
  derived and/or modified sequence opt3 from neuraminidase__InfluenzaA__BAF47929
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuacagagaaggaaauuugccccaaauuagcugaguacaggaauuggaguaagccucaguguaacaucaccggguucgcaccauuuagcaaagacaauuccauacggcugucugccggaggugauauuuggguaacgcgcgagcccuaugugucgugcgacccugauaaguguuaccaauucgcgcuaggccaggggacuacccucaacaauguccauucagacgauacagugcacgaccgaacuccauaucguacccugcuuaugaacgaacugggaguucccuuucauuugggcacaaaacaggugugcaucgcuuggagcaguuccucuugucacgaugguaaggccuggcuccaugucugcgugaccggggacgauaagaaugcaacggccagcuucauuuacaacggaagacugguagacuccaucguuucauggaguaaagagauccugaggacucaggaaagcgagugugugugcauuaauggcacauguaccgucgugaugacugauggcucugcuuccgggaaggcagacacaaaaauacucuuuaucgaggaaggaaagauugugcacaccucaacguuaagcgguagugcccaacacgucgaggaaugcucuugcuauccucgguacccaggcguucgcugugugugcagagauaacuggaagggguccaacaggccgaucguagacauaaauauuaaagacuacagcaucgugucgucuuaugucuguuccggacuggugggcgauacaccccggaagaacgacucaaguagcuccucucauugccuugauccuaauaacgaggaaggugggcacggaguuaaaggcugggcuuucgacgauggcaaugacguguggauggggcgcaccaucagcgagaaguugcgaucaggauacgagacuuuuaaagucauugaagguuggaguaacccaaauuccaagcugcagaucaacagacaggugauuguagauaggggcaaucggagcggguauucuggaauauucucaguugagggcaaaaguuguaucaaccguugcuuuuacguggaacuaauucgcgguagaaaggaggaaaaugagguccucuggaccagcaacuccaucguggucuucugugggacaucuggcacuuauggaaccggcucguggcccgacggggccgauaucaaucugaugccuauuuga

SEQ ID NO: 148075 - RNA, 1410 nt, Artificial Sequence
  derived and/or modified sequence opt3 from neuraminidase__InfluenzaA__BAF47930
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacggacgaacaccauaucguacucugcuuaugaaugaacugggcguucccuuucauuuggguaccaaacaggugugcauugcuuggagcaguuccucuugucacgaugggaaggccuggcuccaugucugcgugacaggagacgauaagaacgcaaccgccagcuucaucuacaauggcagacugguagacuccaucguuucauggaguaaagagauucugaggacgcaggaaagcgagugugugugcauaaacggcacuuguacagucgugaugaccgaugggucugcuuccggaaaggcagacacuaaaauccucuuuauugaggaagguaagaucgugcacacaucaaccuuaagcggcagugcccaacacgucgaggaaugcucuugcuauccucgguacccagggguucgcugugugugcagagauaacuggaagggauccaauaggccgauaguagacauuaacaucaaagauuacagcacggugucgucuuaugucuguuccggccuggugggugacacaccccggaagaaugacucaaguagcuccgggcauugccuugauccuaacaaugaggaaggaggccacggcguuaaagggugggcuuucgacgauggaaacgacguguggaugggucgcaccaucucugagaaguugcgaagcggcuacgagacuuuuaaagucauugaaggguggucaaauccaaacaguaagcugcagaucaauagacaggugauuguagauaggggaaaccgguccggcuauagcgguauauucucuguugaggggaaaucauguaucaaucguugcuuuuacguggaacuaauucgcggcagaaaggaggaaaccgagguccucuggacaaguaacagcaucguggucuucuguggaacuuccggcaccuaugggacaggaucuuggcccgacggugccgauaucaaucugaugccuauuuga

SEQ ID NO: 148076 - RNA, 1410 nt, Artificial Sequence; identical to SEQ ID NO: 142715
  derived and/or modified sequence opt3 from neuraminidase__InfluenzaA__BAF47931

SEQ ID NO: 148077 - RNA, 1410 nt, Artificial Sequence
  derived and/or modified sequence opt3 from neuraminidase__InfluenzaA__BAF47932
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccggucauugccuugacccuaacaaugaggaagggggacacggcguuaaaggcugggcuuucgaugacgggaacgauguguggaugggacgcaccauuucugagaaguugcgaagcgguuacgagacauuuaaagucaucgaaggcuggucaaauccaaacaguaagcugcagauuaauagacaggugauaguagacagggggaaccgguccggauauagcggcaucuucucuguugaggguaaaucauguauuaaucguugcuuuuacguggaacuaauccgcgggagaaaggaggaaacugagguccucuggaccaguaacagcaucguggucuucuguggcacauccggaacuuauggcaccgggucuuggcccgauggagccgacauuaaucugaugccuauauga

SEQ ID NO: 148078 - RNA, 1410 nt, Artificial Sequence; identical to SEQ ID NO: 136728
  derived and/or modified sequence opt3 from neuraminidase__InfluenzaA__BAF47933

SEQ ID NO: 148079 - RNA, 1410 nt, Artificial Sequence; identical to SEQ ID NO: 136730
  derived and/or modified sequence opt3 from neuraminidase__InfluenzaA__BAF47934

SEQ ID NO: 148080 - RNA, 1410 nt, Artificial Sequence; identical to SEQ ID NO: 136730
  derived and/or modified sequence opt3 from neuraminidase__InfluenzaA__BAF47935

SEQ ID NO: 148081 - RNA, 1410 nt, Artificial Sequence
  derived and/or modified sequence opt3 from neuraminidase__InfluenzaA__BAF47936
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcaucacaggggaugacaagaacgcaaccgccagcuucaucuacaauggaagacugguggauuccauuguaucauggaguaaagagauacugaggacgcaggaaagcgaguguguuugcaucaacggcacuuguacaguggucaugaccgacggcucugcuuccgggaaggcagauacuaaaauucucuuuaucgaggaaggaaagauagugcacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccggucauugccuugacccuaacaaugaggaagggggacacggcgugaaaggcugggcuuucgaugacgggaacgauguuuggaugggacgcaccaucucugagaaguugcgaagcgguuacgagacauuuaaagugauugaaggcuggucaaauccaaacaguaagcugcagauaaauagacaggucaucguggacagggggaaccgguccggauauagcggcauuuucucuguagaggguaaaucauguaucaaucguugcuuuuacguugaacuaauccgcgggagaaaggaggaaacugaggugcucuggaccaguaacagcauugucguguucuguggcacauccggaacuuauggcaccgggucuuggcccgauggagccgacauaaaucugaugccuaucuga

SEQ ID NO: 148082 - RNA, 1410 nt, Artificial Sequence
  derived and/or modified sequence opt3 from neuraminidase__InfluenzaA__BAF47937
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcggcccugacaaguguuaccaauucgcgcuagggcagggaacgacucucaacaauguccauucaaacgauaccgugcacgaccgaacaccauaucguacucugcuuaugaaugaacugggcguucccuuucauuuggguaccaaacaggugugcauugcuuggagcaguuccucuugucacgaugggaaggccuggcuccaugucugcgugacaggagacgauaagaacgcaaccgccagcuucaucuacaauggcagacugguagacuccaucguuucauggaguaaagagauucugaggacgcaggaaagcgagugugugugcauaaacggcacuuguacagucgugaugaccgaugggucugcuuccggaaaggcagacacuaaaauccucuuuauugaggaagguaagaucgugcacacaucaaccuuaagcggcagugcccaacacgucgaggaaugcucuugcuauccucgguacccagggguucgcugugugugcagagauaacuggaagggauccaauaggccgauaguagacauuaacaucaaagauuacagcaucgugucgucuuaugucuguuccggccuggugggugacacgccccggaagaaugacucaaguagcuccucucauugccuugauccuaacaaugaggaagggggacacggcguuaaaggcugggcuuucgacgaugggaacgacguguggaugggacgcaccauuagcgagaaguugcgaucagguuacgagacauuuaaagucaucgaaggcuggaguaauccaaacuccaagcugcagauuaauagacaggugauaguagauagggggaaccggagcggauauucuggcaucuucucaguugaggguaaaaguuguauuaaucguugcuuuuacguggaacuaauccgcgggagaaaggaggaaacugagguccucuggaccagcaacuccaucguggucuucuguggcacaucuggaacuuauggcaccgggucguggcccgacggagccgauauuaaucugaugccuauauga

SEQ ID NO: 148083 - RNA, 1410 nt, Artificial Sequence
  derived and/or modified sequence opt3 from neuraminidase__InfluenzaA__BAF47938
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccgaaacuggcugaguacaggaauuggaguaagccccaguguaacauaacaggguucgcaccuuuuagcaaagacaauuccauucggcuaucugccggaggugauaucuggguaacccgcgagccauaugugucgugcgaccccgauaaguguuaccaauucgcgcucggccaggggacgacucugaacaauguccauucaaacgacaccgugcacggacgaacaccuuaucguacucuucugaugaaugaauugggcguuccauuucaucucgguaccaaacaggugugcauugcuuggagcaguuccucuugucacgaugggaaggccuggcugcaugucugcgugacaggagacgauaagaacgcaaccgccagcuucaucuacaauggcagacugguagacuccaucguuucauggaguaaagagauucucaggacgcaggaaagcgagugugugugcauaaacggcacuuguacagucgugaugaccgaugggucugcuuccggaaaggcagacacuaaaaucuuauuuauugaggaagguaagaucgugcacacaucaacccugagcggcagugcccaacacgucgaggaaugcucuugcuauccccgguacccugggguucgcugugugugcagagauaacuggaagggauccaauaggccaauaguagacauuaacaucaaagauuacagcaucgugucgucuuaugucuguuccggccuugugggugacacgccgcggaagaccgacucaaguagcuccucucauugcuuggaucccaauaacgaggaagggggacacggcguuaaaggcugggcuuucgacgaugggaaugacguguggaugggacgcacaauuagcgagaagcugcgaucagguuacgagacuuuuaaagucaucgaaggcuggaguaacccuaauuccaagcuacagauuaacagacaggugauaguagauagggggaaucggagcggauauucuggcaucuucucaguugaggguaaaaguuguauuaaccguugcuuuuacguggaacucauccgcgggagaaaggaggaaaccgagguccuguggacaagcaauuccaucguggucuucuguggcacuucuggaaccuauggcacagggucguggccagacggagccgauauuaaccuuaugcccauauga

SEQ ID NO: 148084 - RNA, 1410 nt, Artificial Sequence; identical to SEQ ID NO: 136730
  derived and/or modified sequence opt3 from neuraminidase__InfluenzaA__BAF47939

SEQ ID NO: 148085 - RNA, 1410 nt, Artificial Sequence
  derived and/or modified sequence opt3 from neuraminidase__InfluenzaA__BAF47940
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaagccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaaaagacugagguccucuggaccagcaauuccaucguggucuucugugggacaucuggcacuuauggaaccggcucguggcccgacggggccgauauuaaccugaugccuauauga

SEQ ID NO: 148086 - RNA, 1410 nt, Artificial Sequence; identical to SEQ ID NO: 136728
  derived and/or modified sequence opt3 from neuraminidase__InfluenzaA__BAF47941

SEQ ID NO: 148087 - RNA, 1410 nt, Artificial Sequence
  derived and/or modified sequence opt3 from neuraminidase__InfluenzaA__BAF47943
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugauugaacugggaguucccuuucauuugggcaccaaacaggugugcaucgcuuggagcaguuccucuugucacgacgguaaggccuggcuccaugucugcgugacaggggaugacaagaaugcaaccgccagcuucaucuacaacggaagacugguagauuccauuguuucauggaguaaagagauacugaggacgcaggaaagcgagugugugugcaucaauggcacuuguacagucgugaugaccgacggcucugcuuccgggaaggcagauacuaaaauucucuuuaucgaggaaggaaagauagugcacacaucaaccuuaagcgguagugcccaacacgucgaggaaugcucuugcuauccucgguacccaggcguucgcugugugugcagagacaacuggaagggguccaacaggccgauuguagauaucaauaucaaagacuacagcauugugucgucuuaugucuguuccggacuggugggcgacacgccccggaagaacgauucaaguagcuccucucauugccuugacccuaauaacgaggaaggugggcacggaguuaaaggcugggcuuucgaugacggcaaugauguguggauggggcgcaccaucagcgagaaguugcgaucaggauacgagacauuuaaagucauugaagguuggaguaacccaaauuccaagcugcagacuaacagacaggugauaguagacaggggcaaucggagcggguauucuggaaucuucucaguugagggcaaaaguuguauuaaccguugcuuuuacguggaacuaauccgcgguagaaaggaggaaaccgagguccucuggacaagcaauuccaucguggucuucugugggacuucuggcaccuauggaacaggcucguggcccgauggggccgacauuaaccugaugccuauauga

SEQ ID NO: 148088 - RNA, 1410 nt, Artificial Sequence
  derived and/or modified sequence opt3 from neuraminidase__InfluenzaA__BAF47944
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuaacagaguacaggaauuggaguaagccucaguguaacauaaccggguucgcuccauuuagcaaagacaauuccauucggcugucugcaggaggugauaucuggguaacgcgcgagcccuaugugucgugcgacccugauaaguguuaccaauucgcccuaggccaggggacuacccucaacaauguccauucaaacgacccagugcacgaucgaacacccuaucguacucugcuuaugaaugaacugggaguuccuuuucauuugggcaccaaacaggugugcauugcguggagcaguuccucuugucacgacgguaaggcuuggcuccaugucugcgugacaggggaugacaagaacgccaccgccagcuucaucuacaauggaagacugguagauuccaucguuucauggaguaaagagauucugaggacgcaggaaagcgagugugugugcauaaacggcacuuguacagucgugaugaccgacggcucugcauccgggaaggcugauacuaaaauccucuuuauugaggaaggaaagaucgugcacacaucaaccuuaagcgguagugcacaacacgucgaggaaugcucuugcuauccacgguacccgggcguucgcugugugugcagagacaacuggaagggguccaauaggcccauaguagauauuaacaucaaagacuacagcaucgugucgucuuaugucuguuccggacuggugggcgacacgccucggaagaaugauucaaguagcuccucucauugccuugacccaaacaaugaggaaggugggcacggaguuaaaggcugggccuucgaugacggcaacgauguguggauggggcgcaccauuagcgagaaguugcgaucaggauacgagacauuuaaagucaucgaagguuggaguaaucccaacuccaagcugcagacuaauagacaggugauuguagacaggggcaaccggagcggguauucuggaauauucucaguugagggcaaaaguuguaucaaucguugcuuuuacguggaacuaauucgcgguagaaaggaggaaaccgagguccucuggacaagcaacuccaucguggucuucugugggacuucuggcaccuauggaacaggcucguggccugauggggcugacaucaaucugaugccaauuuga

SEQ ID NO: 148089 - RNA, 1410 nt, Artificial Sequence
  derived and/or modified sequence opt3 from neuraminidase__InfluenzaA__BAF47945
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaagcugugugaaccgacuauaaucgagagaaauauuaccgaaaucguguauuugacaaacaccacuauugagaaagaaaucugccccaaguuagcugaguacaggaauuggaguaaaccucaguguaacauaacaggguucgcaccauuuagcaaggacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaaaaacgcaaccgccagcuucaucuacaauggaagacugguagauuccaucguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcacacaucaaccuuaagcgguagugcccaacacgucgaggaaugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagaaauugcgaucaggauacgagacauuuaaggucaucgaagguuggaguaauccaaacuccaaacugcagacuaauagacaggugauuguagacaggggcaaccggagcggguauucuggaauauucucaguugagggcaagaguuguaucaaucguugcuuuuacguggaacuaauucgcgguagaaaggaggaaaccgagguccucuggacaagcaacuccaucguggucuucugugggacuucuggcaccuauggaacaggcucguggcccgauggggccgacaucaaucugaugccuauuuga

SEQ ID NO: 148090 - RNA, 1410 nt, Artificial Sequence
  derived and/or modified sequence opt3 from neuraminidase__InfluenzaA__BAF47946
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaaguccuggaagguuggaguaauccaaacuccaagcuacagacuaauagacaggugaucguagacaggggcaaccggagcggguauucuggaauuuucucaguugagggcaaaaguuguauaaaucguugcuuuuacguggaacucauccgcgguagaaaggaggaaaccgagguccuguggacaagcaacuccauuguggucuucugugggacuucuggcaccuauggaacaggcucguggcccgauggggccgacaucaaucuuaugccuaucuga

SEQ ID NO: 148091 - RNA, 1410 nt, Artificial Sequence
  derived and/or modified sequence opt3 from neuraminidase__InfluenzaA__BAF47948
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaaggugcacgaccgaaccccauaucguacacugcuuaugaacgaacugggaguucccuuucauuugggcacuaaacaggugugcauugcuuggagcaguuccucuugucacgaugguaaggccuggcuccaugucugcgugaccggggacgauaaaaaugcaacagccagcuucaucuacaacggaagacugguagacuccaucguuucauggaguaagaaaauucugaggacccaggagagcgaaugugugugcauaaauggcacguguacugucgugaugacagauggcucugcuuccgggaaggcagacaccaagauccucuuuauugaggagggaaaaaucgugcacacuucaacauuaagcgguagugcccaacacgucgaagagugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaagagggugggcacggaguuaaaggcugggcuuucgacgauggcaaugacguguggauggggcgcaccauuagcgaaaaguugcgaucaggauacgagaccuuuaaagucaucgaggguuggaguaacuccaauagcaagcugcagauuaacagacaggugauaguagauaggggcaaucggucuggguauucaggaaucuucaguguugaaggcaagagcuguauuaaccguugcuuuuacguggagcuaauccgcgguagaaaagaagagacagaaguccucuggacuuccaauucuaucguggucuucugugggaccucgggcacauauggaacuggcagcuggccagacggggccgauauuaaccugaugcccauauga

SEQ ID NO: 148092 - RNA, 1410 nt, Artificial Sequence
  derived and/or modified sequence opt3 from neuraminidase__InfluenzaA__BAF47949
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaaggugcacgaccgaaccccauaucguacacugcuuaugaacgaacugggaguucccuuucauuugggcacuaaacaggugugcauugcuuggagcaguuccucuugucacgaugguaaggccuggcuccaugucugcgugaccggggacgauaaaaaugcaacagccagcuucaucuacaacggaagacugguagacuccaucguuucauggaguaagaaaauucugaggacccaggagagcgaaugugugugcauaaauggcacguguacugucgugaugacagauggcucugcuuccgggaaggcagacaccaagauccucuuuauugaggagggaaaaaucgugcacacuucaacauuaagcgguagugcccaacacgucgaagagugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaagagggugggcacggaguuaaaggcugggcuuucgacgauggcaaugacguguggauggggcgcaccauuagcgaaaaguugcgaucaggauacgagaccuuuaaagucaucgaggguuggaguaacccaaauuccaagcugcagauuaacagacaggugauaguagauaggggcaaucggagcggguauucuggaaucuucucaguugaaggcaagaguuguauuaaccguugcuuuuacguggagcuaauccgcgguagaaaagaagagacagaaguccucuggacuagcaauuccaucguggucuucugugggaccucuggcacauauggaacuggcucguggcccgacggggccgauauuaaccugaugccuauauga

SEQ ID NO: 148093 - RNA, 1410 nt, Artificial Sequence; identical to SEQ ID NO: 136730
  derived and/or modified sequence opt3 from neuraminidase__InfluenzaA__BAF47950

SEQ ID NO: 148094 - RNA, 1410 nt, Artificial Sequence
  derived and/or modified sequence opt3 from neuraminidase__InfluenzaA__BAF47951
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacuccaauagcaaacugcagauuaacagacaggugauaguagauaggggcaaucggucuggguauucaggaaucuucaguguugaaggcaagagcuguauuaaccguugcuuuuacguggagcuaauccgcgguagaaaggaagagacugaaguccucuggaccuccaauucuaucguggucuucugugggacaucgggcacuuauggaaccggcagcuggccagacggggccgauauuaaccugaugcccauauga

SEQ ID NO: 148095 - RNA, 1410 nt, Artificial Sequence
  derived and/or modified sequence opt3 from neuraminidase__InfluenzaA__BAF47952
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagacuaauagacaggugauuguagacaggggcaaccggagcggguauucuggaauauucucaguugagggcaaaaguuguaucaaucguugcuuuuacguggaacuaauucgcgguagaaaggaggaaaccgagguccucuggacaagcaacuccaucguggucuucugugggacuucuggcaccuauggaacaggcucguggcccgauggggccaauaucaaccugaugccuauuuga

SEQ ID NO: 148096 - RNA, 1410 nt, Artificial Sequence
  derived and/or modified sequence opt3 from neuraminidase__InfluenzaA__BAF47953
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgaugagaaugcaaccgccagcuucaucuacaacggaagacugguagacuccaucguuucauggaguaagaaaauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 148097 - RNA, 1410 nt, Artificial Sequence; identical to SEQ ID NO: 148049
  derived and/or modified sequence opt3 from neuraminidase__InfluenzaA__BAF47954

SEQ ID NO: 148098 - RNA, 1410 nt, Artificial Sequence; identical to SEQ ID NO: 148049
  derived and/or modified sequence opt3 from neuraminidase__InfluenzaA__BAF47955

SEQ ID NO: 148099 - RNA, 1410 nt, Artificial Sequence
  derived and/or modified sequence opt3 from neuraminidase__InfluenzaA__BAF47956
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggacuggugggcgacacgccccgcaaaaacgauucaaguagcuccucucacugccuugacccuaauaacgaggaaggugggcauggaguuaagggcugggcuuucgaugacggcaaugauguguggauggggcgaaccauuagcgagaaauugagaucaggauacgagacauuuaaggucaucgaagguuggaguaacccaaauuccaaacugcagauuaacaggcaagugauaguagaccggggcaaucguagcggguauucuggaaucuucucaguugagggcaagaguuguauuaaccgcugcuuuuacguggaacuaaucagagguaggaaggaggaaacugagguccucuggaccagcaauuccaucguggucuucugugggacaucuggcacuuauggaaccggcucguggcccgauggggccgacauuaacuucaugccuauauga

SEQ ID NO: 148100 - RNA, 1410 nt, Artificial Sequence
  derived and/or modified sequence opt3 from neuraminidase__InfluenzaA__BAF47958
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugaugaugaacgaacuuggaguucccuuucaccugggcaccaaacaggugugcauugcuuggagcaguuccucuugucaugacgguaaggccugguugcacgucugcgugacaggggaugacaaaaaugcaaccgccagcuucaucuacaacggaaggcucguagauuccaucguuucauggaguaaggagauucugcggacgcaggaaagcgagugugugugcauaaauggcacuuguacagucgugaugaccgacggcucugcuuccgggaaagcagauacuaagauccuguuuauugaggaaggaaagaucgugcauacaucaacccucagcgguagugcccaacacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggauuagugggcgacacgccccgcaaaaacgauucaaguagcuccucucacugccuggacccuaauaacgaggaaggugggcauggaguuaagggcugggcuuucgaugacggcaaugauguguggauggggcgaaccauuagcgagaaacuuagaucaggauacgagacauuuaaggucaucgaagguuggaguaacccaaauuccaaauugcagauuaacaggcaagugauaguagaccggggcaaucguagcggguauucuggaaucuucucaguugagggcaagaguuguauuaaccgcugcuuuuacguggaacugaucagagguaggaaggaggaaacugagguccuauggaccagcaauuccaucguggucuucugugggacaucuggcacuuauggaaccggcucguggacagauggggccgacauuaacuucaugcccauauga

SEQ ID NO: 148101 - RNA, 1410 nt, Artificial Sequence
  derived and/or modified sequence opt3 from neuraminidase__InfluenzaA__BAF47959
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacuauaccgugcacgaccgaacaccauaccguacucugcuuaugaaugaacugggaguucccuuucauuugggcaccaaacaggugugcauugcuuggagcaguuccucuugucacgaugguaaggccuggcuccaugucugcgugacaggggacgauaagaacgcaaccgccagcuucaucuauaauggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuacccucgguacccaggcguucgcugugugugcagagauaacuggaagggguccaauaggccgauaguagacauuaacaucaaagauuauagcaucgugucgucuuacgucuguuccggacuggugggcgacacgccccggaagaaugacucaaguagcuccggucauugccuugauccuaacaaugaggaagggggacacggcguuaaaggcugggcuuucgacgaugggaacgacguguggaugggacgcaccauuucugagaaguugcgaagcgguuaugagacauuuaaagucaucgaaggcuggucaaauccaaacaguaagcugcagauuaauagacaggugauaguagauagggggaaccgguccggauacagcggcaucuucucuguugaggguaaaucauguauuaaucguugcuuuuauguggaacuaauccgcgggagaaaggaggaaacugagguccucuggaccaguaacagcaucguggucuucuguggcacauccggaacuuacggcaccgggucuuggcccgacggagccgauauuaaucugaugccuauauga

SEQ ID NO: 148102 - RNA, 1410 nt, Artificial Sequence
  derived and/or modified sequence opt3 from neuraminidase__InfluenzaA__BAF47960
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacaaucgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaauuggaagggguccaacaggccgauaguagacauuaauaucaaagauuacagcaucgugucgucuuaugucuguuccggacuggugggcgacacgccccggaagaacgacucaaguagcuccggucauugccuugauccuaauaacgaggaagggggacacggcguuaaaggcugggcuuucgacgaugggaaugacguguggaugggacgcaccauuucugagaaguugcgaagcgguuacgagacauuuaaagucaucgaaggcuggucaaacccaaauaguaagcugcagauuaacagacaggugauaguagauagggggaaucgguccggauauagcggcaucuucucuguugaggguaaaucauguauuaaccguugcuuuuacguggaacuaauccgcgggagaaaggaggaaacugagguccucuggaccaguaauagcaucguggucuucuguggcacauccggaacuuauggcaccgggucuuggcccgacggagccgauauuaaccugaugccuauauga

SEQ ID NO: 148103 - RNA, 1410 nt, Artificial Sequence
  derived and/or modified sequence opt3 from neuraminidase__InfluenzaA__BAF47975
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggaaaggguccaaccggccgauaguagauauuaauaucaaggacuacagcaucgugucgucuuaugucuguuccggacuggugggcgacacgccccgcaaaaacgauucaaguagcuccucucacugccuugacccuaauaacgaggaaggugggcauggaguuaagggcugggcuuucgaugacggcaaugauguguggauggggcgaaccauuagcgagaaauugagaucaggauacgagacauuuaaggucaucgaagguuggaguaacccaaauuccaaacugcagauuaacaggcaagugauaguagaccggggcaaucguagcggguauucuggaaucuucucaguugagggcaagaguuguauuaaccgcugcuuuuacguggaacuaaucagagguaggaaggaggaaacugagguccucuggaccagcaauuccaucguggucuucugugggacaucuggcacuuauggaaccggcucguggcccgauggggccgacauuaaccacaugccuauauga

SEQ ID NO: 148104 - RNA, 1410 nt, Artificial Sequence; identical to SEQ ID NO: 136728
  derived and/or modified sequence opt3 from neuraminidase__InfluenzaA__BAF47976

SEQ ID NO: 148105 - RNA, 1410 nt, Artificial Sequence
  derived and/or modified sequence opt3 from neuraminidase__InfluenzaA__BAF47977
augaaccccaaucagaagaucauuaccauaggcagcgugucccugacaaucucuacuauuugcuucuuuaugcaaaucgccauucucaucacgaccgucacacuucaguucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaauguaacauaacaggguucgcaccauuuagcaaagacaauuccauucggcugucugccggaggugauaucuggguaacccgcgagcccuaugugucgugcgacccugauaaguguuaccaguucgcgcuaggccaggggacgacucucaacaauguccacucaaacgacaccgugcauggacgaacaccauaucguacucugcuuaugaaugaacugggcguucccuuucacuuggguaccaaacaggugugcauugcuuggagcaguuccucuugucaugaugggaaggccuggcuccacgucugcgugacaggagacgauaagaacgcaaccgccagcuucaucuacaauggcagacugguagacuccaucguuucauggaguaaagagauucugaggacgcaagaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccagcacgucgaggaaugcucuugcuauccucgguacccagggguucgcugugugugcagagauaacuggaagggauccaauaggccgauaguagacauuaacaucaaagauuacagcaucgugucgucuuaugucuguuccggccuggugggugacacgccccggaagaaugacucaaguagcuccucucacugccuugauccuaacaaugaggaagggggacauggcguuaaaggcugggcuuucgacgaugggaacgacguguggaugggacgcaccauuagcgagaaguugcgaucagguuacgagacauuuaaagucaucgaaggcuggaguaauccaaacuccaagcugcagacuaauagacaggugauuguagauagggggaaccggagcggauauucuggcauauucucaguugaggguaaaaguuguaucaaucguugcuuuuacguggaacuaauucgcgggagaaaggaggaaaccgagguccucuggacaagcaacuccaucguggucuucuguggcacuucuggaaccuauggcacagggucguggcccgacggagccgauaucaaucugaugccuauuuga

SEQ ID NO: 148106 - RNA, 1410 nt, Artificial Sequence
  derived and/or modified sequence opt3 from neuraminidase__InfluenzaA__BAF47978
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucaguguaacaucacaggguucgcaccauuuagcaaagacaauuccauacggcugucugccggaggugauauuugggugacccgcgagcccuaugucucgugcgacccugauaaguguuaccaauucgcgcuaggccaggggacgacucucaacaaugugcauucaaacgacaccguucacgaucgaacaccauaucguacucugcuuaugaaugaacugggagugcccuuucauuugggcaccaagcaggucugcaucgcuuggagcaguuccucuugucacgacgguaaagccuggcuccaugugugcguaacaggggaugacaagaacgcaaccgccagcuucauuuacaauggaagacugguugauuccaucgugucauggaguaaagagauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugccuggauggggcgcaccaucagcgagaaguugcgaucaggauacgagacauuuaaagucauugaagguuggaguaauccaaacuccaagcugcagaucaauagacaggugauuguagacaggggcaaccggagcggguauucuggaauauucucaguugagggcaaaaguuguaucaaucguugcuuuuacguggaacuaauucgcgguagaaaggaggaaacugagguccucuggaccagcaacuccaucguggucuucugugggacaucuggcacuuauggaaccggcucguggcccgauggggcggacaucaaucugaugccuauuuga

SEQ ID NO: 148107 - RNA, 1410 nt, Artificial Sequence
  derived and/or modified sequence opt3 from neuraminidase__InfluenzaA__BAF47979
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacaaucgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaauuggaagggguccaacaggccgauaguagacauuaauaucaaagauuacagcaucgugucgucuuaugucuguuccggacuggugggcgacacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagacuaacagacaggugauuguagauaggggcaaucggagcggguauucuggaauauucucaguugagggcaaaaguuguaucaaccguugcuuuuacguggaacuaauucgcgguagaaaggaggaaaccgagguccucuggacaagcaauuccaucguggucuucugugggacuucuggcaccuauggaacaggcucguggcccgacggggccgauaucaaccugaugccuauuuga

SEQ ID NO: 148108 - RNA, 1410 nt, Artificial Sequence; identical to SEQ ID NO: 138580
  derived and/or modified sequence opt3 from neuraminidase__InfluenzaA__BAF47980

SEQ ID NO: 148109 - RNA, 1410 nt, Artificial Sequence
  derived and/or modified sequence opt3 from neuraminidase__InfluenzaA__BAF47981
augaaccccaaucagaagaucauuaccauaggcagcgugucccugacaaucucuacuauuugccucuucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaaguggaguaaaccucaguguaauauaacaggguuugcaccauucagcaaggacaacuccauucggcuaucugccggaggugauaucuggguaacccgcgagcccuaugugucgugcgacccugauaaguguuaccaauuugcgcucggccaggggacgacucugaauaacguccauucaaaugacaccgugcgaaaccguacaccauauagaacucuucugaugaaugaauugggaguucccuuccaccucggcaccaaacaggugugcauugcuuggagcaguuccucuugucaugaugguaaggccuggcugcacgucugcgugacaggggacgauaaaaacgcaaccgccagcuuuaucuacaauggaaggcugguagacuccaucguuucauggaguaaggagauucuccggacgcaggaaagcgagugugugugcauaaacggcacuuguacagucgugaugaccgauggcucugcuuccgggaaagcagacacuaagaucuuauucauugaggaaggaaagaucgugcauacaucaacccugagcgguagugcccaacacgucgaggaaugcucuugcuauccucgcuacccaggcguuagaugugugugcagggauaacuggaaaggguccaaucggccgauaguagacauuaacaucaaggauuacagcaucgugucgucuuaugucuguuccggacuugugggcgacacgccccgcaaaaaugacucaaguagcuccucucacugcuuggauccuaacaaugaggaaggugggcauggaguuaagggcugggcuuuugacgauggcaacgacguguggauggggcgaaccauuagcgagaaacugagaucaggauacgagacauucaaggucaucgaagguuggaguaauccaaacuccaaacuacagauuaauaggcaagugauaguagaucggggcaaccguagcggguauucuggaaucuuuucaguugagggcaagaguuguauuaaucgcugcuucuacguggaacucaucagagguaggaaggaggaaacugagguccuguggaccagcaacuccaucguggucuuuugugggacaucuggcacuuauggaaccggcucguggcccgacggggccgauauuaaucuuaugccuauauga

SEQ ID NO: 148110 - RNA, 1410 nt, Artificial Sequence
  derived and/or modified sequence opt3 from neuraminidase__InfluenzaA__BAF47982
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgaaaccguacaccauauagaacucugcuuaugaaugaacugggaguucccuuucacuugggcaccaaacaggugugcauugcuuggagcaguuccucuugucaugaugguaaggccuggcuccacgucugcgugacaggggacgauaaaaacgcaaccgccagcuucaucuacaauggaaggcugguagacuccaucguuucauggaguaaggagauucugcggacgcaggaaagcgagugugugugcauaaacggcacuuguacagucgugaugaccgauggcucugcuuccgggaaagcagacacuaagauccucuuuauugaggaaggaaagaucgugcauacaucaaccuuaagcgguagugcccaacacgucgaggaaugcucuugcuauccucgcuacccaggcguuagaugugugugcagggauaacuggaaaggguccaaucggccgauaguagacauuaacaucaaggauuacagcaucgugucgucuuaugucuguuccggacuggugggcgacacgccccgcaaaaaugacucaaguagcuccucucacugccuugauccuaacaaugaggaaggugggcauggaguuaagggcugggcuuucgacgauggcaacgacguguggauggggcgaaccauuagcgagaaauugagaucaggauacgagacauuuaaggucaucgaagguuggaguaauccaaacuccaaacugcagauuaauaggcaagugauaguagaucggggcaaccguagcggguauucuggaaucuucucaguugagggcaagaguuguauuaaucgcugcuuuuacguggaacuaaucagagguaggaaggaggaaacugagguccucuggaccagcaacuccaucguggucuucugugggacaucuggcacuuauggaaccggcucguggcccgacggggccgauauuaaucugaugccuauauga

SEQ ID NO: 148111 - RNA, 1410 nt, Artificial Sequence; identical to SEQ ID NO: 138580
  derived and/or modified sequence opt3 from neuraminidase__InfluenzaA__BAF47983

SEQ ID NO: 148112 - RNA, 1410 nt, Artificial Sequence
  derived and/or modified sequence opt3 from neuraminidase__InfluenzaA__BAF47984
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacggacgaacaccauaucguacucugcuuaugaaugaacugggcguucccuuucauuuggguaccaaacaggugugcauugcuuggagcaguuccucuugucacgaugggaaggccuggcuccaugucugcgugacaggagacgauaagaacgcaaccgccagcuucaucuacaauggcagacugguagacuccaucguuucauggaguaaagagauucugaggacgcaggaaagcgagugugugugcauaaacggcacuuguacagucgugaugaccgaugggucugcuuccggaaaggcagacacuaaaauccucuuuauugaggaagguaagaucgugcacacaucaaccuuaagcggcagugcccaacacgucgaggaaugcucuugcuauccucgguacccagggguucgcugugugugcagagauaacuggaagggauccaauaggccgauaguagacauuaacaucaaagauuacagcaucgugucgucuuaugucuguuccggccuggugggugacacgccccggaagaaugacucaaguagcuccucucauugccuugauccuaacaaugaggaaggggaccacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggcccgauggggccgacauuaaucugaugccuauauga

SEQ ID NO: 148113 - RNA, 1410 nt, Artificial Sequence
  derived and/or modified sequence opt3 from neuraminidase__InfluenzaA__BAF47985
augaaccccaaucagaagaucauuaccauaggcagcgugucccugacaaucucuacuauuugcuucuuuaugcaaaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaaugauaccgugcacgaccgaacaccauaucguacucugcuuaugaacgaacugggaguucccuuccauuugggcaccaaacaggugugcauugcuuggucaagcaguuccugucacgaugguaaagccuggcuccaugucugcgugacaggggacgauaagaaugcaaccgccucuuuuaucuacaacggaagacugguagacagcaucguuuccuggucaaagaagauucugaggacgcaggagagugaaugugugugcauaaauggcacuuguacagucgugaugaccgauggcagcgcuucugggaaagcagacacuaagauccucuucauugaggagggaaagaucgugcacacauccaccuuaucagguagcgcccaacacgucgaagagugcaguugcuauccucgguacccaggcguucgcugugugugcagagauaacuggaaagggucuaacaggccgauaguagacauuaauaucaaggacuacuccaucgugagcucguaugucuguucuggacuggugggcgauacgccccggaaaaacgacuccucaaguagcucccauugccuugauccuaauaacgaagagggugggcacggaguuaagggcugggcuuuugacgauggcaaugacguguggauggggcgcaccauuucugaaaaauugcgaagcggauacgagacauucaaggucaucgaggguuggucaaacccaaauaguaaacugcagauuaacagacaggugauaguagauaggggcaaucgguccggguauagcggaaucuuuucuguugaaggcaagucauguauuaaccguugcuucuacguggagcuaauccgcgguagaaaggaagagacugaaguccucuggaccaguaauagcaucguggucuucugugggacauccggcacuuauggaaccggcucuuggcccgacggggccgauauuaaccugaugccuauauga

SEQ ID NO: 148114 - RNA, 1410 nt, Artificial Sequence
  derived and/or modified sequence opt3 from neuraminidase__InfluenzaA__BAF47986
augaaccccaaucagaagaucauuaccauaggcagcgugucccugacaaucucuacuauuugcuucuuuaugcaaaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaaugauaccgugcacgaccgaacaccauaucguacucugcuuaugaacgaacugggaguucccuuccauuugggcaccaaacaggugugcauugcuuggucaagcaguuccugucacgaugguaaagccuggcuccaugucugcgugacaggggacgauaagaaugcaaccgccucuuuuaucuacaacggaagacugguagacagcaucguuuccuggucaaagaagauucugaggacgcaggagagugaaugugugugcauaaauggcacuuguacagucgugaugaccgauggcagcgcuucugggaaagcagacacuaagauccucuucauugaggagggaaagaucgugcacacauccaccuuaucagguagcgcccaacacgucgaagagugcaguugcuauccucgguacccaggcguucgcugugugugcagagauaacuggaaagggucuaacaggccgauaguagacauuaauaucaaggacuacuccaucgugagcucguaugucuguucuggacuggugggcgauacgccccggaaaaacgacuccucaaguagcucccauugccuugauccuaauaacgaagagggugggcacggaguuaagggcugggcuuuugacgauggcaaugacguguggauggggcgcaccauuucugaaaaauugcgaagcggauacgagacauucaaggucaucgaggguuggucaaacccaaauaguaaacugcagauuaacagacaggugauaguagauaggggcaaucgguccggguauagcggaaucuuuucuguugaaggcaagucauguauuaaccgucgcuucuacguggagcuaaucagagguaggaaggaagagacugaaguccucuggaccaguaauagcaucguggucuucugcgggacauccggcacuuauggaaccggcucuuggcccgacggggccgauauuaaccugaugccuauauga

SEQ ID NO: 148115 - RNA, 1410 nt, Artificial Sequence
  derived and/or modified sequence opt3 from neuraminidase__InfluenzaA__BAF47987
augaaccccaaucagaagaucauuaccauaggcagcgugucccugacaaucucuacuauuugcuucuuuaugcaaaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaaugauaaggugcacgaccgaaccccauaucguacacugcuuaugaacgaacugggaguucccuuccauuugggcacuaaacaggugugcauugcuuggucaagcaguuccugucacgaugguaaggccuggcuccaugucugcgugaccggggacgauaaaaaugcaacagccucuuuuaucuacaacggaagacugguagacagcaucguuuccuggucaaagaaaauucugaggacccaggagagugaaugugugugcauaaauggcacguguacugucgugaugacagauggcagcgcuucugggaaggcagacaccaagauccucuucauugaggagggaaaaaucgugcacacuuccacauuaucagguagcgcccaacacgucgaagagugcaguugcuauccucgguacccaggcguucgcugugugugcagagauaacuggaaggggucuaacaggccgauaguagacauuaauaucaaagacuacuccaucgugagcucguaugucuguucuggacuggugggcgauacuccccggaagaacgacuccucaaguagcucccauugccuugauccuaauaacgaagagggugggcacggaguuaaaggcugggcuuuugacgauggcaaugacguguggauggggcgcacgauuucugaaaaguugcgaagcggauacgagaccuucaaagucaucgaggguuggucaaacccaaauaguaagcugcagauuaacagacaggugauaguagauaggggcaaucgguccggguauagcggaaucuuuucuguugaaggcaagucauguauuaaccguugcuucuacguggagcuaauccgcgguagaaaagaagagacagaaguccucuggaccaguaauagcaucguggucuucugugggaccuccggcacauauggaacuggcucuuggcccgacggggccgauauuaaccugaugccuauauga

SEQ ID NO: 148116 - RNA, 1410 nt, Artificial Sequence; identical to SEQ ID NO: 136730
  derived and/or modified sequence opt3 from neuraminidase__InfluenzaA__BAF47988

SEQ ID NO: 148117 - RNA, 1410 nt, Artificial Sequence; identical to SEQ ID NO: 136730
  derived and/or modified sequence opt3 from neuraminidase__InfluenzaA__BAF47989

SEQ ID NO: 148118 - RNA, 1410 nt, Artificial Sequence
  derived and/or modified sequence opt3 from neuraminidase__InfluenzaA__BAF47990
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucaucaugaccgacggcucugcuuccgggaaggcagauacuaaaauucucuuuaucgaggaaggaaagauagugcacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccgugagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggcccgauggggccgacauuaaucugaugccuauauga

SEQ ID NO: 148119 - RNA, 1410 nt, Artificial Sequence
  derived and/or modified sequence opt3 from neuraminidase__InfluenzaA__BAF47991
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauauugugcacgaccgaaccccauaucguacacugcuuaugaacgaacugggaguucccuuucauuugggcacuaaacaggugugcaucgcuuggagcaguuccucuugucacgaugguaaggccuggcuccaugucugcgugaccggggacgauaagaaugcaacagccagcuucaucuacaacggaagacugguagacuccauuguuucauggaguaaaaagauacugaggacccaggagagcgaaugugugugcaucaauggcacguguacugucgugaugacagauggcucugcuuccgggaaagcagacaccaagauucucuuuaucgaggagggaaagauagugcacacuucaacauuaagcgguagugcccaacacgucgaagagugcucuugcuauccucgguacccaggcauucgcuguguuugcagagauaacuggaaaggguccaacaggccgaucguggacaucaauauuaaggacuacagcaucguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccauuagcgaaaaauugcgaucaggauacgagaccuuuaaggugauagaggguuggaguaacccaaauuccaaacugcagaucaacagacaggucauuguggauaggggcaaucggagcggguauucuggaaucuucucaguagaaggcaagaguuguaucaaccguugcuuuuacguugagcuaauucgcgguagaaaggaagagacagaagugcucuggacuagcaauuccauagucguguucugugggaccucuggcacauauggaacuggcucguggcccgacggggccgauaucaaccugaugccuauuuga

SEQ ID NO: 148120 - RNA, 1410 nt, Artificial Sequence
  derived and/or modified sequence opt3 from neuraminidase__InfluenzaA__BAF47992
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgaaccugacaaguguuacccauucgcgcuaguccaaggcacgacucucaacaaugugcauucaaacgauaccguucacgaccgaacacccuaucguacucugcuuaugaaugagcugggggugccuuuucauuugggaaccaagcaggucugcauugcuuggagcaguuccucuugucacgauggcaaagccuggcuccaugugugcguaacaggugacgauaagaacgcaaccgccagcuucaucuacaaugggagacugguugacuccaucgugucauggaguaaagaaauucugaggacgcaggagagcgagugugucugcauaaacggaacuuguacaguggugaugaccgauggcucugcuuccggcaaggcagacacuaaaauccucuuuauugaagaggggaagaucguccacacaucaaccuuaagcggaagugcccagcacguugaagagugcucuugcuauccacgguacccgggugugcgcuguguaugcagagauaacuggaagggcuccaauaggcccauaguggacauuaacaucaaagauuacagcaucgucucgucuuauguguguuccgggcugguuggagacacgccucggaagaaugacucaaguagcuccggccauugccuugauccaaacaaugaagagggugggcacggagugaaaggcugggcuuucgacgauggcaacgacgucuggauggggcgcaccauuucugagaaguugcgaagcggauacgaaacauuuaaagugaucgaggguuggucaaaucccaacaguaagcugcaaauuaauagacagguaauaguugauaggggcaaccgguccggguauagcggaaucuucucuguggaaggcaaaucauguauuaaucguugcuuuuacgucgagcuaauccgcgguagaaaggaagagacugaggugcucuggaccaguaacagcuucgucguguucugugggacauccggcacuuauggaaccggcucuuggccugacggggccgauaucaaucugaugccaauuuga

SEQ ID NO: 148121 - RNA, 1410 nt, Artificial Sequence; identical to SEQ ID NO: 148077
  derived and/or modified sequence opt3 from neuraminidase__InfluenzaA__BAF47993

SEQ ID NO: 148122 - RNA, 1410 nt, Artificial Sequence; identical to SEQ ID NO: 136728
  derived and/or modified sequence opt3 from neuraminidase__InfluenzaA__BAF47994

SEQ ID NO: 148123 - RNA, 1410 nt, Artificial Sequence
  derived and/or modified sequence opt3 from neuraminidase__InfluenzaA__BAF47995
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacggacgaacaccauaucguacucugcuuaugaaugaacugggcguucccuuucauuuggguaccaaacaggugugcauugcuuggagcaguuccucuugucacgaugggaaggccuggcuccaugucugcgugacaggagacgauaagaacgcaaccgccagcuucaucuacaauggcagacugguagacuccaucguuucauggaguaaagagauucugaggacgcaggaaagcgagugugugugcauaaacggcacuuguacagucgugaugaccgaugggucugcuuccggaaaggcagacacuaaaauccucuuuauugaggaagguaagaucgugcacacaucaaccuuaagcggcagugcccaacacgucgaggaaugcucuugcuauccucgguacccagggguucgcugugugugcagagauaacuggaagggauccaauaggccgauaguagacauuaacaucaaagauuacagcaucgugucgucuuaugucuguuccggccuggugggugacacgccccggaagaaugacucaaguagcuccucucauugccuugauccuaacaaugaggaagggggacacggcguuaaaggcugggcuuucgacgaugggaacgacguguggaugggacgcaccauuagcgagaaguugcgaucagguuacgagacauuuaaagucaucgaaggcuggaguaauccaaacuccaagcugcagauuaauagacaggugauaguagauagggggaaccggagcggauauucuggcaucuucucaguugaggguaaaaguuguauuaaucguugcuuuuacguggaacuaauccgcgggagaaaggaggaaacugagguccucuggaccagcaacuccaucguggucuucuguggcacaucuggaacuuauggcaccgggucguggcccgacggagccgauauuaaucugaugccuauauga

SEQ ID NO: 148124 - RNA, 1410 nt, Artificial Sequence; identical to SEQ ID NO: 148123
  derived and/or modified sequence opt3 from neuraminidase__InfluenzaA__BAF47996

SEQ ID NO: 148125 - RNA, 1410 nt, Artificial Sequence; identical to SEQ ID NO: 136730
  derived and/or modified sequence opt3 from neuraminidase__InfluenzaA__BAF47997

SEQ ID NO: 148126 - RNA, 1410 nt, Artificial Sequence
  derived and/or modified sequence opt3 from neuraminidase__InfluenzaA__BAF57504
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacaguguaacauaacaggguucgcacccuuuaguaaagacaauagcauucggcuguccgccggaggugauaucuggguaacccgcgagccuuaugugucuucggacccagauaagugcuaccaauucgcgcuaggccaggggacgacucucaacaauguccauucaaacgacaccgugcacgaucgaacacccuaucguacucugcuuaugaaggaacugggaguuccuuuucauuugggcaccaaacagguguguauugcuuggagcaguuccucuugccacgacgguaaggccuggcuccaugucugugugacaggggaugacgagaaugcaaccgccagcuucaucuacaacggaagacugguagauuccguugugucauggaguaaaaagauccugaggacgcaggaaagcgagugcgucuguauuaauggcacuugcacaguggugaugaccgacggcucugcuuccgggaaagcagauacuaagauacucuuuaucgaggaaggaaagauuguccacacaagcucauuaagugguucugcccaacacguugaggaauguuccugcuauccacgguacccgggcgugcgcugcguauguagagacaacuggaaagggagcaacaggcccaucguggauauaaauauuaaggacuacucgaucgucucuuccuaugugugcucaggacugguuggcgacaccccucggaaaaacgauaguagcuccucuagccauugucuugacccaaauaacgaggaaggugggcacggagugaagggcugggcuuucgaugacggcaaugaugucuggauggggcgcacgaucucagagaaauugcgaaguggauacgagaccuuuaaggugauugaagguugguccaaccccaauagcaaacugcagaucaacagacagguaauuguugacaggggcaaucggucuggguauucaggaauauucaguguggagggcaagagcugcaucaaccguuguuuuuacgucgaacuaauucgcgguagaaagcaggagacagaagugcucuggacuuccaauucuaucgucguguucugcgggaccucgggcacauauggaacuggcagcuggccugauggggccgacaucaaccugaugccaauuuga

SEQ ID NO: 148127 - RNA, 1410 nt, Artificial Sequence
  derived and/or modified sequence opt3 from neuraminidase__InfluenzaA__BAF57508
augaaccccaaucagaagaucauuaccauaggcagcgugucccugacaaucucuacuauuugcuucuuuaugcaaaucgccauucucaucacgacccuuacacugcacuucaaacaguacgaguuuaacucaccuccaaauaaccaggucauguugugugaaccgacuauaaucgagagaaauauuaccgaaaucguuuauuuaacaaacaccacuauugagaaggaaaucugccccaaacuggcugaguacaggaauuggaguaagccucaguguaacauaacaggguucgcaccauuuagcaaagacaauuccauucggcuaucugccggaggugauaucugggugacccgcgagcccuauguaucgugcgacccugauaaguguuaccaauucgcgcucggccaggggacgacucugaacaaugugcauucaaacgacaccguccacgaucgaacaccauaucguacucuucugaugaaugaauugggagugcccuuucaucucggcaccaagcagguuugcauugcuuggagcaguuccucuugucacgacgguaaagccuggcugcaugugugcgucacaggggaugacgagaacgcaaccgccagcuucaucuacaauggaagacugguggauuccaucguaucauggaguaagaaaauucucaggacgcaggaaagcgaguguguuugcauaaacggcacuuguacaguggucaugaccgacggcucugcuuccgggaaggcagauacuaaaaucuuauuuauugaggaaggaaagaucgugcacacaucaacccugagcgguagugcccaacacguggaggaaugcucuugcuauccucgguacccaggcguccgcuguguuugcagagacaacuggaagggguccaauaggccgauaguggauauuaacaucaaagacuacagcaucguaucgucuuauguguguuccggacuugucggcgacacgccccggaagaaugauucaaguagcuccucucauugcuuggacccuaacaaugaggaaggugggcacggagugaaaggcugggcuuucgaugacggcaacgauguuuggauggggcgcaccauuagcgagaagcugcgaucaggauacgagacauuuaaagugaucgaagguuggaguaauccaaacuccaagcuacagauuaauagacaggucauaguggacaggggcaaccggagcggguauucuggaaucuucucaguagagggcaaaaguuguauuaaucguugcuuuuacguugaacucauccgcgguagaaagcaggagacugaagugcuguggaccagcaacuccaucgucguguucugugggacaucuggcacuuauggaaccggcucguggcccgauggggccgacauuaaucuuaugccuauauga

SEQ ID NO: 148128 - RNA, 1410 nt, Artificial Sequence; identical to SEQ ID NO: 137945
  derived and/or modified sequence opt3 from neuraminidase__InfluenzaA__BAF57511

SEQ ID NO: 148129 - RNA, 1410 nt, Artificial Sequence
  derived and/or modified sequence opt3 from neuraminidase__InfluenzaA__BAF57515
augaaccccaaucagagaaucauuaccauaggcagcgugucccugacaaucucuacuauuugcuucuuuaugcaaaucgccauucucaucacgaccgucacacuucacuucaagcaguacgaguuuaacucaccuccaaauaaccagguuaugcugugugaaccgacuauaaucgagaggaauauuaccgaaaucguguauuugacaaacaccacuauugagaaagaaaucugccccaaguuagcugaguaccggaauuggaguaaaccucaguguaacauaacaggguucgcaccauuuagcaaggacaauuccauucgccugucugccggaggugauaucuggguaacccgagagcccuaugugucgugcgacccugauaaauguuaccaauucgcgcuaggccaggggacgacucucaacaauguccauucaaacgacaaggugcacgaucguaccccauauagaacacugcuuaugaaugaacugggaguucccuuucauuugggcacuaaacaggugugcauugcuuggagcaguuccucuugucacgacgguaaggccuggcuccaugucugcgugaccggggaugacgagaacgcaacagccagcuucaucuacaauggaaggcugguagauuccaucguuucauggaguaagaaaauucugcggacccaggaaagcgagugugugugcauaaacggcacguguacugucgugaugacagacggcucugcuuccgggaaggcagauaccaaaauccucuuuauugaggaaggaaagaucgugcacacuucaacauuaagcgguagugcccaacacgucgaggaaugcucuugcuauccucgcuacccaggcguuagaugugugugcagggacaacuggaagggguccaaucggccgauaguagauauuaacaucaaagacuacagcaucgugucgucuuaucuguguuccggacuugucggcgacacgccccgcaagaaugauucaaguagcuccucucauugcuuggacccuaacaaugaggaaggugggcacggagugaaaggcugggcuuucgaugacggcaacgauguuuggauggggcgaaccauuagcgagaagcugagaucaggauacgagaccuuuaaagugaucgaagguuggagucauccaaauucccagcuacagauuaacaggcaggucauaguggaccggggcaaucguagcggguauucuggaaucuucucaguagagggcaagaguuguauuaaccgcugcuuuuacguugaacucaucagagguaggaaacaagagacagaagugcuguggacuagcaauuccaucgucguguucugugggaccucuggcacauauggaacuggcucguggcccgauggggccgacauuaaccuuaugccuauauga

SEQ ID NO: 148130 - RNA, 1410 nt, Artificial Sequence
  derived and/or modified sequence opt3 from neuraminidase__InfluenzaA__BAF57522
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccauuaucgagaaggaaauaugccccaaauuagcugaguacaggaauuggaguaagccucaguguaacauuacuggguucgcaccauuuagcaaagacaauuccauccggcugucugccggaggugauauuuggguaacacgcgagcccuaugugucgugcgacccugauaaguguuaccaauucgcgcuaggccaggggaccacgcucaacaauguccauucaaacgacacugugcacgaucgaaccccauaucguacacugcuuaugaaugaacugggaguucccuuucauuugggcacuaaacaggugugcaucgcuuggagcaguuccucuugucacgacgguaaggccuggcuccaugucugcgugaccggggaugacgagaacgcaacagccagcuucaucuacaauggaagacugguagauuccauuguuucauggaguaagaaaauacugaggacccaggaaagcgagugugugugcaucaacggcacguguacugucgugaugacagacggcucugcuuccgggaaggcagauaccaaaauucucuuuaucgaggaaggaaagauagugcacacuucaacauuaagcgguagugcccaacacgucgaggaaugcucuugcuauccucgguacccaggcguucgcugugugugcagagacaacuggaagggguccaauaggccgauuguagauaucaacaucaaagacuacagcauugugucgucuuaugucuguuccggacuggugggcgacacgccccggaagaaugaucgcucacgaaguagccauugccuugacccuaacaaugaggaaggugggcacggaguuaaaggcugggcuuucgaugacggcaacgauguguggauggggagaaccaucuccgagaaguugaggucuggauacgagaccuuuaaagucauugaagguuggagcaagccaaauucaaaacugcagauaaaccgucaggugaucguagaccggggcaaucgcacaggguauaguggaauuuucuccguugagggcaagagcuguaucaacagaugcuuuuacguggaacuaaucaggggucggaagcaggagacugaaguccucuggaccucuaauucaauuguggucuucugugggacaaguggcacuuauggaaccggcagcuggcccgauggggccgacauaaaccugaugccuaucuga

SEQ ID NO: 148131 - RNA, 1410 nt, Artificial Sequence
  derived and/or modified sequence opt3 from neuraminidase__InfluenzaA__BAF57529
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaaggugcacgaacgaaccccauaucguacacugcuuaugaacgagcugggaguucccuuucauuugggcacuaaacaggugugcauugcuuggagcaguuccucuugucacgacgguaaggccuggcuccaugucugcgugaccggggaugacaaaaaugcaacagccagcuucaucuacaacggaagacugguagauuccaucguuucauggaguaagaaaauucugaggacccaggaaagcgagugugugugcauaaauggcacguguacugucgugaugacagacggcucugcuuccgggaaggcagauaccaagauccucuuuauugaggaaggaaaaaucgugcacacuucaacauuaagcgguagugcccaacacgucgaggaaugcucuugcuauccucgguacccaggcguucgcugugugugcagagacaacuggaagggguccaacaggccgauaguagauauuaauaucaaagacuacagcaucgugucgucuuaugucuguuccggacuggugggcgacacgccccggaagaacgauucaaguagcuccucucauugccuugacccuaauaacgaggaaggugggcacggaguuaaaggcugggcuuucgaugacggcaaugauguguggauggggcgcaccauuagcgagaaguugcgaucaggauacgagaccuuuaaagucaucgaagguuggaguaacccaaauuccaagcugcagauuaacagacaggugauaguagacaggggcaaucggagcggguauucuggaaucuucucaguugagggcaagaguuguauuaaccguugcuuuuacguggaacuaauccgcgguagaaaagaggaaacagagguccucuggacuagcaauuccaucguggucuucugugggaccucuggcacauauggaacuggcucguggcccgauggggccgacauuaaccugaugccuauauga

SEQ ID NO: 148132 - RNA, 1410 nt, Artificial Sequence; identical to SEQ ID NO: 143567
  derived and/or modified sequence opt3 from neuraminidase__InfluenzaA__BAF57532

SEQ ID NO: 148133 - RNA, 1410 nt, Artificial Sequence; identical to SEQ ID NO: 143567
  derived and/or modified sequence opt3 from neuraminidase__InfluenzaA__BAF57536

SEQ ID NO: 148134 - RNA, 1410 nt, Artificial Sequence
  derived and/or modified sequence opt3 from neuraminidase__InfluenzaA__BAF57539
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaagccuggcuccaugucugcgugacaggggacgauaagaaugcaaccgccagcuucaucuacaacggaagacugaucgacuccauuguaucauggaguaaaaagauacugaggacgcaggagagcgaauguguuugcaucaauggcacuuguacaguggucaugaccgauggcucugcuuccgggaaagcagacacuaagauucucuuuaucgaggagggaaagauagugcacacaucaaccuuaagcgguagugcccaacacguggaagagugcucuugcuauccucgguacccaggcguccgcuguguuugcagagauaacuggaaaggguccaacaggccgauuguggacaucaauaucaaggacuacagcauuguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccaucagcgaaaaauugcgaucaggauacgagacauuuaaggugauugaggguuggaguaacccaaauuccaaacugcagauaaacagacaggucaucguggauaggggcaaucggagcggguauucuggaauuuucucaguagaaggcaagaguuguaucaaccguugcuuuuacguugagcuaauccgcgguagaaaggaaaagacugaggugcucuggaccagcaauuccauugucguguucugugggacaucuggcacuuauggaaccggcucguggcccgacggggccgauauaaaccugaugccuaucuga

SEQ ID NO: 148135 - RNA, 1410 nt, Artificial Sequence
  derived and/or modified sequence opt3 from neuraminidase__InfluenzaA__BAF57543
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucugccaucuucucaguugaaggaaagaguuguauuaaccguugcuuuuacguggagcuaauccgcggcagaaaggaagagacugaaguccucuggaccagcaauuccaucguggucuucugugguacaucugggacuuauggcaccggaucguggcccgacggcgcggauauuaaccugaugccuauauga

SEQ ID NO: 148136 - RNA, 1410 nt, Artificial Sequence
  derived and/or modified sequence opt3 from neuraminidase__InfluenzaA__BAF57547
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacugaagcccucuggaccagcaauuccaucgucguguucugugggacaucuggcacuuauggaaccggcucguggcccgacggggcggauauuaaccugaugccuauauga

SEQ ID NO: 148137 - RNA, 1410 nt, Artificial Sequence; identical to SEQ ID NO: 136730
  derived and/or modified sequence opt3 from neuraminidase__InfluenzaA__BAF57551

SEQ ID NO: 148138 - RNA, 1410 nt, Artificial Sequence; identical to SEQ ID NO: 136730
  derived and/or modified sequence opt3 from neuraminidase__InfluenzaA__BAF57555

SEQ ID NO: 148139 - RNA, 1410 nt, Artificial Sequence; identical to SEQ ID NO: 136728
  derived and/or modified sequence opt3 from neuraminidase__InfluenzaA__BAF57559

SEQ ID NO: 148140 - RNA, 1410 nt, Artificial Sequence
  derived and/or modified sequence opt3 from neuraminidase__InfluenzaA__BAF57563
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauauugugcacgaccgaaccccauaucguacacugcuuaugaacgaacugggaguucccuuucauuugggcacuaaacaggugugcaucgcuuggagcaguuccucuugucacgaugguaaggccuggcuccaugucugcgugaccggggacgauaagaaugcaacagccagcuucaucuacaacggaagacugguagacuccauuguuucauggaguaaagagauacugaggacccaggaaagcgagugugugugcaucaauggcacguguacugucgugaugacagauggcucugcuuccgggaaggcagacaccaaaauucucuuuaucgaggaaggaaagauagugcacacuucaacauuaagcgguagugcccaacacgucgaggaaugcucuugcuauccucgguacccaggcguucgcugugugugcagagauaacuggaagggguccaacaggccgauuguagacaucaauaucaaagacuacagcauugugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccaucagcgagaaguugcgaucaggauacgagaccuuuaaagucauugaagguuggaguaacccaaauuccaagcugcagauaaacagacaggugaucguagauaggggcaaucggagcggguauucuggaauuuucucaguugagggcaaaaguuguaucaaccguugcuuuuacguggaacuaauccgcgguagaaaggaggaaacagagguccucuggacuagcaauuccauuguggucuucugugggaccucuggcacauauggaacuggcucguggcccgacggggccgauauaaaccugaugccuaucuga

SEQ ID NO: 148141 - RNA, 1410 nt, Artificial Sequence; identical to SEQ ID NO: 136728
  derived and/or modified sequence opt3 from neuraminidase__InfluenzaA__BAF57571

SEQ ID NO: 148142 - RNA, 1410 nt, Artificial Sequence; identical to SEQ ID NO: 143472
  derived and/or modified sequence opt3 from neuraminidase__InfluenzaA__BAF57575

SEQ ID NO: 148143 - RNA, 1410 nt, Artificial Sequence; identical to SEQ ID NO: 136343
  derived and/or modified sequence opt3 from neuraminidase__InfluenzaA__BAF57579

SEQ ID NO: 148144 - RNA, 1410 nt, Artificial Sequence
  derived and/or modified sequence opt3 from neuraminidase__InfluenzaA__BAF57583
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauauccgcguaacccgagagcccuaugugucgugcgacccugauaaguguuaccaauucgcgcuaggccaggggacgacucucaacaauguccauucaaacgacaccgugcacgaucguacaccauauagaacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaaggcugguagauuccaucguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgcuacccaggcguuagaugugugugcagggacaacuggaagggguccaaucggccgauaguagauauuaacaucaaagacuacagcaucgugucgucuuaugucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaaguugagaucaggauacgagacauuuaaagucaucgaagguuggaguaauccaaacuccaagcugcagauuaauaggcaagugauaguagaccggggcaaccguagcggguauucuggaaucuucucaguugagggcaaaaguuguauuaaucgcugcuuuuacguggaacuaaucagagguaggaaggaggaaacugagguccucuggaccagcaacuccaucguggucuucugugggacaucuggcacuuauggaaccggcucguggcccgauggggccgacauuaaucugaugccuauauga

SEQ ID NO: 148145 - RNA, 1410 nt, Artificial Sequence
  derived and/or modified sequence opt3 from neuraminidase__InfluenzaA__BAF57587
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaaggaaaucugucccaaauuagcugaguauaggaauuggaguaagccucagugcaacauaacaggguucgcaccauuuagcaaagacaauuccauucggcugucugccggaggugauaucuggguaacccgcgagcccuacgugucgugugacccugauaagugcuaucaauucgcgcuaggccaggggacgacucucaacaauguccauucaaacgacaccgugcacgaucgaacaccauaccguacucugcuuaugaaugaacugggaguucccuuucauuugggcaccaaacagguguguauugcuuggagcaguuccucuugccacgacgguaaggccuggcuccaugucugugugacaggggaugacaagaacgcaaccgccagcuucaucuauaauggaagacugguagauuccaucguuucauggaguaaagagauucugaggacgcaggaaagcgagugcguguguauaaacggcacuugcacagucgugaugaccgacggcucugcuuccgggaaggcagauacuaaaauccucuuuauugaggaaggaaagaucgugcacacaucaaccuuaagcgguagugcccaacacgucgaggaaugcucuuguuacccucgguauccaggcguucgcugcguguguagagacaacuggaagggguccaauaggccgauaguagauauuaacaucaaagacuacagcaucgugucgucuuacgucugcuccggacuggugggcgacacgccccggaagaaugauucaaguagcuccucucauugucuugacccuaacaaugaggaaggugggcacggaguuaaaggcugggcuuucgaugacggcaacgauguguggauggggcgcaccauuagcgagaaguugcgaucaggauaugagacauuuaaagucaucgaagguuggaguaauccaaacuccaagcugcagauuaauagacaggugauaguagacaggggcaaccggagcggguacucuggaaucuucucaguugagggcaaaaguugcauuaaucguuguuuuuauguggaacuaauccgcgguagaaaggaggaaacugagguccucuggaccagcaacuccaucguggucuucugcgggacaucuggcacuuacggaaccggcucguggcccgauggggccgacauuaaucugaugccuauauga

SEQ ID NO: 148146 - RNA, 1410 nt, Artificial Sequence
  derived and/or modified sequence opt3 from neuraminidase__InfluenzaA__BAF57591
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguacauauuaauaucaaagacuacagcaucgugucgucuuaugucuguuccggacuggugggcgacacgccccggaagaacgauucaaguagcuccucucacugccuuaauccuaacaaugaggaaggugggcauggaguuaaaggcugggcuuucgacgauggcaacgacguguggauggggcgcaccauuagcgagaaguugcgacugggauacgagacauuuaaagucaucgaagguuggucaaauccaaacaguaagcuacagauuaauagacaggugauaguagauaggggcaaccgguccggguauagcggaaucuucucuguugagggcaaaucauguauuaaucguugcuuuuacguggaacucauccgcgguagaaaggaggaaacugagguccuguggaccaguaacagcaucguggucuucugugggacauccggcacuuauggaaccggcucuuggcccgacggggccgauauuaaucuuaugccuauauga

SEQ ID NO: 148147 - RNA, 1410 nt, Artificial Sequence
  derived and/or modified sequence opt3 from neuraminidase__InfluenzaA__BAF57595
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaauagcugaguacaggaauuggaguaagccucaguguaacauuacaggguucgcaccauuuagcaaagacaauuccauccgguuaucugccggaggugauauuuggguaacccgcgagcccuaugugucgugcgacccugauaaguguuaccaauucgcgcugggccaggggacgacucuaaacaauguccauucaaacgacaccgugcacgaucgaacaccauaucguacucuccugaugaaugaacuuggaguucccuuucaucugggcaccaaacaggugugcaucgcuuggagcaguuccucuugucacgacgguaaggccugguugcaugucugcgugacaggggaugacaagaacgcaaccgccagcuucaucuacaauggaagacucguagauuccauuguuucauggaguaaagagauacugaggacgcaggaaagcgagugugugugcgucaacggcacuuguacaguggugaugaccgacggcucugcuuccgggaaggcagauacuaaaauccuguuuauugaggaaggaaagaucguccacacaucaacccucagcgguagugcccaacacguugaggaaugcucuugcuauccucgguacccaggcgugcgcuguguaugcagagacaacuggaagggguccaauaggccgauaguggauauuaacaucaaagacuacagcaucgucucgucuuauguguguuccggauuaguuggcgacacgccccggaagaaugauucaaguagcuccucucauugccuggacccuaacaaugaggaaggugggcacggagugaaaggcugggcuuucgaugacggcaacgaugucuggauggggcgcaccauuagcgagaaacuucgaucaggauacgagacauuuaaggugaucgaagguuggaguaauccaaacuccaaguugcagauuaauagacagguaauaguugacaggggcaaccggagcggguauucuggaaucuucucaguggagggcaaaaguuguauuaaucguugcuuuuacgucgaacugauccgcgguagaaaggaggaaacugaggugcuauggaccagcaacuccaucgucguguucugugggacaucuggcacuuauggaaccggcucguggcccgauggggccgacauuaaucucaugccuauauga

SEQ ID NO: 148148 - RNA, 1410 nt, Artificial Sequence; identical to SEQ ID NO: 143472
  derived and/or modified sequence opt3 from neuraminidase__InfluenzaA__BAF57599

SEQ ID NO: 148149 - RNA, 1410 nt, Artificial Sequence
  derived and/or modified sequence opt3 from neuraminidase__InfluenzaA__BAF57603
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccagacuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucgggaccagcaauuccaucguggucuucuguggcacaucuggaacuuauggcaccgggucguggcccgacggagccgauauuaaccugaugccuauauga

SEQ ID NO: 148150 - RNA, 1410 nt, Artificial Sequence; identical to SEQ ID NO: 143567
  derived and/or modified sequence opt3 from Neuraminidase__InfluenzaA__BAF62620

SEQ ID NO: 148151 - RNA, 1413 nt, Artificial Sequence
  derived and/or modified sequence opt3 from neuraminidase__InfluenzaA__BAF63036
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucacuaucaauaacaccaauguuguggcagggaaagacaagacaucgguaacccuugccggaaacucaagccuguguaguauuuccggcugggcgaucuacacuaaagauaauucuaucaggauugguagcaagggggacguguucgucauacgggagccuuuuaucuccugcucacauuuggagugucgcacauucuuuuuaacccaaggagcucugcuaaacgauaaacacaguaauggcacggugaaggaccgaagcccauaucgugcccucaugucuugcccgcugggcgaagcacccuccccuuacaacucaaaguucgagagcguugccuggagugcuucugcaugucaugaugggaugggauggcuuacuauugguaucuccggcccagacaauggggccguggcuguccugaaauauaacggaauaauuaccgaaacaaucaagagcuggaaaaagagaaucuugaggacucaggagucggagugcguguguguaaacggcucuugcuuuaccauuaugacagauggucccuccaauggggccgcgucauacaaaaucuucaagauugaaaagggaaaaguuaccaagaguauagagcucaacgcaccuaauuuucacuaugaagaguguagcugcuacccagacacgggcacugugaugugugucugccgggauaacuggcacggcuccaaucgccccugggugucuuucaaccagaaucuggacuaccagaucggguauauuugcagcggaguguuuggugauaacccuagaccaaaagacggcaaggggucauguaauccggucacaguugauggagccgacggcgugaaagguuucaguuacaaguaugggaacggcguauggaucggaaggaccaaauccaaucggcugcgcaagggcuuugagaugaucugggaccccaacggguggacugauacagacagcgauuucucugugaagcaagacgucguggcuauuaccgauuggucaggauacagugguagcuuuguucagcauccugaacucacgggcuuagacugcauacgaccauguuucuggguggagcuggucagagggcuucccagggaaaauaccacaaucuggacuuccggaucuucgauuagcuucugcggcgugaacuccgauaccgccaauuggucauggccugacggugcagaguugccauuuacaaucgauaaauga

SEQ ID NO: 148152 - RNA, 1413 nt, Artificial Sequence; identical to SEQ ID NO: 143457
  derived and/or modified sequence opt3 from neuraminidase__InfluenzaA__BAF63040

SEQ ID NO: 148153 - RNA, 1413 nt, Artificial Sequence
  derived and/or modified sequence opt3 from neuraminidase__InfluenzaA__BAF63047
augaaccccaaucagaagaucauuaccauaggcagcaucuccauugccaucgggauuaucucucuggugcuccaaauaggaaacaucauuucaaucugggcuagucacagcauucagacagguucccagaaucauacuggcaucugcaaccagagaauaauuacguacgaaaauucuaccugggucaaccacacauauguuaauaucaacaauacuaacgugguagcagggaaagacaagaccucggugacacuugccggaaauucaagccuguguaguauuuccggcugggcgaucuacaccaaagauaacucuaucaggauugguagcaagggggacgucuucgugauacgggagccuuuuaucuccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgauugguaucuccggcccagacaacggggccgucgcugugcugaaauauaacggaauaauuacugaaaccaucaagagcuggaaaaagagaaucuugaggacacaggagucggagugcguauguguuaauggcucuugcuuuacuauuaugaccgauggucccuccaacggggccgcgucauacaaaaucuucaagauugaaaagggaaaagugacaaagaguauagagcucaaugcaccuaacuuucacuaugaagaguguagcugcuacccagacaccggcacggucaugugugugugccgggauaauuggcacggcuccaaccgccccugggugucuuucaaucagaaccuggacuaccagaucggguauauuugcagcggagucuuuggugauaauccuagaccaaaagacggcgaggggucauguaacccgguuacuguggauggagccgacggcguaaaggguuucaguuacaaauaugggaauggcguguggaucggaaggacaaaguccaaccggcugcgcaaaggcuuugaaaugaucugggaccccaauggguggaccgauacugacagcgauuucucugucaagcaagacgugguugcuauuacagauuggucaggauacagugguagcuuugugcagcauccugagcucaccggcuuagacugcauacgaccauguuucugggucgaacuggugagagggcuucccagggagaacacgaccaucuggacauccggaucuucgauuagcuucugcggcguaaauuccgauacugccgacuggucauggccugauggugcagaauugccauuuaccaucgacaaguga

SEQ ID NO: 148154 - RNA, 1413 nt, Artificial Sequence
  derived and/or modified sequence opt3 from neuraminidase__InfluenzaA__BAF63058
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccugugugcgauuaguggcugggcuaucuacaccaaagauaacuccaucaggauugguucuaagggggacguguucgucauacgggagccuuuuaucagcugcucccauuuggagugucgcacuuucuuuuuaacacaaggagcccugcuaaaugauaaacacucaaacggcaccgugaaggaccgaaguccauaucgugcacucaugagcugcccgcugggcgaagcccccucuccuuacaauuccaaguucgagucaguugcuuggagcgcaagugccugucaugaugggaugggauggcuuacgauugguaucucuggcccagacaacggggcuguggccguccugaaauauaacggaauaauuacugaaaccaucaaguccuggaaaaagagaaucuugaggacacaggagagcgagugcguguguguaaauggcucgugcuuuacuauuaugaccgauggucccucuaacgaagcggcauccuacaaaaucuucaagauugagaaggggaaaguuacaaagucaauagaacucaaugccccuaacuuucacuaugaggaguguaguugcuacccagacaccggaacggugaugugugucugccgggauaauuggcacggcagcaaccgccccuggguguccuucaauccuaaccuggacuaccagaucggcuauauuugcucugggguguuuggagauaauccaagaccgaaagacggugaaggcagcuguaaccccgucacuguugauggggcugacggagugaagggcuucucauacaaauaugguaaugggguauggaucggcaggacaaagaguaaccggcugcgcaaaggauuugagauggugugggacccuaauggcuggaccgauacugacuccgauuucagcgucaagcaggacgugguugccaucacagauuggucuggguacucaggaaguuuugugcaacauccagaacucaccgguuuagacugcauucgacccuguuucugggucgagcuggugagaggccuuccuaaggaaaacacgaccauauggacaagcggguccucuaucucguucugcggaguaaauagcgauacugcaaacugguccuggccagacggcgcugaguugcccuuuaccauugauaaauga

SEQ ID NO: 148155 - RNA, 1413 nt, Artificial Sequence; identical to SEQ ID NO: 143457
  derived and/or modified sequence opt3 from neuraminidase__InfluenzaA__BAF63065

SEQ ID NO: 148156 - RNA, 1413 nt, Artificial Sequence; identical to SEQ ID NO: 143457
  derived and/or modified sequence opt3 from neuraminidase__InfluenzaA__BAF63069

SEQ ID NO: 148157 - RNA, 1413 nt, Artificial Sequence; identical to SEQ ID NO: 143457
  derived and/or modified sequence opt3 from neuraminidase__InfluenzaA__BAF63079

SEQ ID NO: 148158 - RNA, 1413 nt, Artificial Sequence; identical to SEQ ID NO: 143457
  derived and/or modified sequence opt3 from neuraminidase__InfluenzaA__BAF63092

SEQ ID NO: 148159 - RNA, 1413 nt, Artificial Sequence; identical to SEQ ID NO: 143457
  derived and/or modified sequence opt3 from neuraminidase__InfluenzaA__BAF63098

SEQ ID NO: 148160 - RNA, 1413 nt, Artificial Sequence
  derived and/or modified sequence opt3 from neuraminidase__InfluenzaA__BAF63104
augaaccccaaucagaagaucauuaccauaggcagcaucuccauugccaucgggauuaucucucugaugcuccaagugggaauagucguuucaaucugggcuagucacagcauucagacagguucccagaaccauacuggcaucugcaaucagagaauuaucacguacgagaacucuaccugggugaaucacacauauguaaacauaaauaacacuaauguggucgcagggaaagacaagaccucgguggcccuugcgggaaacucaagccuguguaguauuuccggcugggcuaucuacacaaaagauaauucuauuaggaucgguagcaagggggacguuuucgugauccgggaaccuuuuauuuccugcucacauuuggagugucgcaccuucuuuuuaacucaaggagcccugcuaaacgauaaacacaguaauggcacagucaaggaccgaagcccauaucgugcacucaugucuugcccgcugggcgaagcccccuccccuuacaacucaaaguucgagagcguggcuuggagugcaucugccugucaugaugggaugggauggcuuaccauagguaucuccggcccagacaauggggcuguagccguucugaaauauaacggaauuaucacggaaacuauaaagagcuggaaaaagagaauuuugaggacccaggagucggagugcgugugugucaacggcucuugcuuuacaaucaugacugauggucccuccaauggggcggcaucauacaaaaucuucaagauugaaaagggacaggugaccaaaaguguggagcucaacgccccuaauuuucacuaugaagaguguagcugcuacccagacacaggcaccgucauguguguuugccgggauaacuggcacggcuccaaucgccccugggugucuuucaaccagaaucuggacuaccaaaucggguauauuugcagcggaguauuuggugauaacccuagaccaaaggacggcaaagggucauguaauccggugacggucgauggagcugacggcgugaaggguuucaguuacaaauaugggaacggcguuuggauaggaaggacuaaguccaaucggcugcgcaaaggcuuugagaugaucugggaccccaacggguggacagauaccgacagcgauuucucugugaagcaggacgucguggccauuacugauuggucaggauacagugguagcuuuguacagcauccugaacucacaggcuuagacugcauccgaccauguuucuggguugagcuggugagagggcuucccagggaaaauaccacgaucuggaccuccggaucuucgauuagcuucugcggcgucgauuccgacacagcaaacuggucauggccugauggugcugaguugccauuuacuauagacaaguga

SEQ ID NO: 148161 - RNA, 1413 nt, Artificial Sequence
  derived and/or modified sequence opt3 from neuraminidase__InfluenzaA__BAF63112
augaaccccaaucagaagaucauuaccauaggcagcaucuccauugccaucgggauuaucucucugaugcuccaagugggaaacauaaucucaauuugggcuagucacagcauccagacagguucccagaaucauacuggcauuugcaaccagagaaucauaacguacgagaauagcaccugggucaaccacacauauguuaauauuaacaauacuaacgugguagcagggaaagacaagaccucgguggcccuugcgggaaauucaagccuguguaguaucuccggcugggcuauuuacacaaaagauaacucuaucaggaucgguagcaagggggacgucuucgugauucgggaaccuuuuauauccugcucacauuuggagugucgcaccuucuuuuuaacucaaggagcccugcuaaaugauaaacacaguaacggcacaguuaaggaccgaagcccauaucgugcacucaugucuugcccgcugggcgaagcccccuccccuuacaauucaaaguucgagagcguggcuuggagugcaucugccugucaugaugggaugggauggcuuaccaucgguauuuccggcccagacaacggggcugucgccgugcugaaauauaacggaaucauaacggaaacuauuaagagcuggaaaaagagaaucuugaggacccaggagucggagugcguauguguuaauggcucuugcuuuacaaucaugacugauggucccuccaacggggcggcaucauacaaaauuuucaagaucgaaaagggacaggugaccaaaagugucgagcucaaugccccuaacuuucacuaugaagaguguagcugcuacccagacacaggcaccgugaugugugugugccgggauaauuggcacggcuccaaccgccccugggucucuuucaaucagaaccuggacuaccaaauuggguauauaugcagcggaguuuuuggugauaauccuagaccaaaggacggcaaagggucauguaacccggugacgguagauggagcugacggcgugaaggguuucaguuacaaauaugggaauggcgucuggaucggaaggacuaaguccaaccggcugcgcaaaggcuuugagaugauuugggaccccaauggguggacagauaccgacagcgauuucucugugaagcaggacguuguggccaucacugauuggucaggauacagugguagcuuuguccagcauccugaacucacaggcuuagacugcauccgaccauguuucuggguggagcugguaagagggcuucccagggaaaacaccacgauuuggaccuccggaucuucgauaucuuucugcggcguugauuccgacacagcaaauuggucauggccugauggugcugaguugccauuuacuaucgacaaguga

SEQ ID NO: 148162 - RNA, 1413 nt, Artificial Sequence
  derived and/or modified sequence opt3 from neuraminidase__InfluenzaA__BAF63116
augaaccccaaucagaagaucauuaccauaggcagcaucuccauugccaucgggauuaucucucugaugcuccaagugggaaacauaaucucaauuugggcuagucacagcauccagacagguucccagaaucauacuggcauuugcaaccagagaaucauaacguacgagaauagcaccugggucaaccacacauauguuaauauuaacaauacuaacgugguagcagggaaagacaagaccucgguggcccuugcgggaaauucaagccuguguaguaucuccggcugggcuauuuacacaaaagauaacucuaucaggaucgguagcaagggggacgucuucgugauucgggaaccuuuuauauccugcucacauuuggagugucgcaccuucuuuuuaacucaaggagcccugcuaaaugauaaacacaguaacggcacaguuaaggaccgaagcccauaucgugcacucaugucuugcccgcugggcgaagcccccuccccuuacaauucaaaguucgagagcguggcuuggagugcaucugccugucaugaugggcuuggauggcugaccaucgguauuuccggcccagacaacggggcugucgccguguugaaauauaacggaaucauaacggaaacuauuaagagcuggaaaaagagaauccucaggacccaggagucggagugcguauguguuaauggcucuugcuuuacaaucaugacugauggucccuccaacggggcggcaucauacaaaauuuucaagaucgaaaagggacaggugaccaaaagugucgagcugaaugccccuaacuuucacuaugaagaguguagcugcuacccagacacaggcaccgugaugugugugugccgggauaauuggcacggcuccaaccgccccugggucucuuucaauccugaccuggauuaccagauuggguauauaugcagcggaguuuuuggugacaacccaagaccgaaggauggcaaagggucauguaaucccgugacgguagacggagcugacggcgugaaggguuucaguuacaaauaugggaacggcgucuggaucggaaggacuaaguccaaucggcuccgcaaaggcuuugagaugauuugggauccuaacggguggacagacaccgauagcgacuucucugugaagcaagauguuguggccaucacugacuggucaggauacagugguagcuuuguccagcauccagaauuaacaggccuggauugcauccgacccuguuucuggguggagcuuguaagaggguugccuagggaaaauaccacgauuuggaccuccggaucuucgauaucuuucugcggcguugacuccgauacagcaaacuggucauggccagacggugcugagcugcccuuuacuaucgauaaguga

SEQ ID NO: 148163 - RNA, 1413 nt, Artificial Sequence
  derived and/or modified sequence opt3 from neuraminidase__InfluenzaA__BAF63124
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagagucgggagcucaaugcaccuaacuuucacuaugaagaguguagcugcuacccagacaccggcacggugaugugugucugccgcgauaauuggcacggcuccaacagacccugggugucuuucaauccuaaccuggacuaccagauaggguauaucugcagcggaguggucggugauaauccaaggccgaaagacggcaaggggucauguaaccccguuacugccgauggagcugacggcgugaaagguuuuaguuacaaguaugggaauggcguauggauuggacggacaaaauccaaccgccugcgaaagggcuucgagaugaucugggacccuaauggguggaccgauacugacagcgauuuuucugugaagcaggacgucguggccaucacagauuggucaggauacagugguagcuucguucaacauccagaacucaccggcuuagacugcauuagacccuguuuuuggguggagcuggucagggggcuuccucgggaaaacacgaccauauggacauccggaucuucgaucagcuucugcggcguggauuccgacacugcaaauuggucauggccagauggugcugaguugcccuucaccauugacaaauga

SEQ ID NO: 148164 - RNA, 1413 nt, Artificial Sequence; identical to SEQ ID NO: 143519
  derived and/or modified sequence opt3 from neuraminidase__InfluenzaA__BAF63132

SEQ ID NO: 148165 - RNA, 1413 nt, Artificial Sequence
  derived and/or modified sequence opt3 from neuraminidase__InfluenzaA__BAF63136
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggaguguaaaacuuucuuuuuaacacaaggagcucugcuaaaugauaagcacaguaacggcaccgugaaggaccgcagcccauaucgagcccucaugucuugcccgcugggcgaagcacccuccccuuacaauucaaaauucgagagcguugccuggagugcuucugcaugucaugaugggaugggauggcuuacgauugguaucuccggcccagacaacggggccguggcuguccugaaguauaacggaauaauuacuggcaccaucaaaagcuggaagaaacagaucuugcguacacaggaaucggagugcguguguaugaaugguucuugcuuuacuauuaugaccgaugggcccuccaacggagccgcgucauacaagaucuucaagauugagaaaggcaagguaacaaaaaguauagaacucaaugcaccuaacuuucacuaugaggaauguagcugcuacccagacaccggcacgguuaugugugugugcagagauaauuggcacggguccaacaggcccugggucucuuucaaucagaaccuggacuaccaaaucggauauauuugcagcgguguguuuggcgauaauccucggccaaaggacggggagggaucauguaacccggugacugucgauggcgccaaugguguuaaaggguucaguuacaaguauggcaacggaguguggaucggccgcacaaaauccaauagacugaggaagggguuugagaugaucugggaccccaacggauggaccaauacugacagcgauuucucuguaaagcaggacguggucgcuauuacagauuggucagguuacaguggcagcuuugugcagcauccugaacucaccggguuagacugcauacggccauguuucuggguugagcuggugcgcggacuuccccgagaaaacacgaccaucuggacauccgguucuucgauuagcuucugcggcgucaacuccgauacugccaauuggucauggccugacggggcagaguugccauuuaccaucgauaaauga

SEQ ID NO: 148166 - RNA, 1350 nt, Artificial Sequence
  derived and/or modified sequence opt3 from neuraminidase__InfluenzaA__BAH24021
augaaccccaaucagaagaucauuaccauaggcagcaucugcauggugauugggaucgucucccugaugcuccaaauuggaaacaugguuucucuuugggugucacacaguauccagacagguaaucagcaucagguagagccuauaagcaacacuaauuuccugacggaaaaagccguggcuuccgucaccuuggcaggcaacucuucguuauguccaaucagagggugggccgugcacucaaaggacaauagcauuaggaucggaaguaaaggcgauguuuuugugauucgggagccguucaucuccugcucucaucuggaaugucgcacauuuuuccuaacucaaggugcgcuccugaacgacaagcacagcaaugggaccgucaaagaucgaagcccccaucguacacuuaugucaugcccugugggagaggcuccaagucccuacaacagcagauuugaaucuguagccugguccgcaucagccugucacgacggcaccagcuggcugacuauaggcauuagugggccugauaauggagcuguugcaguguugaaguauaacgguaugaucacagacaccauuaagucuuggaggaauaacauccuccggacgcaggaguccgagugcgccugugucaauggcagcugcuucacugugaugaccgaugggccaucgaacggacaggcuucuuacaaaaucuuuaagauggaaaaaggcaagguggucaaauccguugagcuggacgcccccaacuaucacuacgaagaguguucaugcuauccugaugcgggugagauuacaugugugugccgcgacaauuggcaugggaguaacagaccauggguauccuucaaucagaaccuggaauaccaaauaggauauaucugcuccggcguguuuggcgauaauccgaggcccaacgggggaacugguucuuguggcccugucagcccaaauggggcauacggagugaagggcuucucauuuaaguacgguaacgggguuuggauuggccggaccaaaagucccuccagccgcucuggauucgagaugaucugggacccuaauggcuggacagaaaccgauucaaguuuuagcgugaagcaggacauagucgccauuacggacugguccggguauucuggaucguucgugcagcacccagagcucacugguuuagauugcauccgacccuguuucuggguagaacugaucagaggcaggccgaaagagagcacaauuuggaccuccgggucaaguaucucuuuuugcggaguuaacagcgacacuguguccuggucauggccugauggcgcugagcuucccuucacaauugacaaguga

SEQ ID NO: 148167 - RNA, 1410 nt, Artificial Sequence; identical to SEQ ID NO: 138909
  derived and/or modified sequence opt3 from neuraminidase__InfluenzaA__BAH95825

SEQ ID NO: 148168 - RNA, 1410 nt, Artificial Sequence; identical to SEQ ID NO: 138744
  derived and/or modified sequence opt3 from neuraminidase__InfluenzaA__BAH95826

SEQ ID NO: 148169 - RNA, 1410 nt, Artificial Sequence
  derived and/or modified sequence opt3 from neuraminidase__InfluenzaA__BAJ07994
augaaccccaaucagaagaucaccacaauuggcagcauaugcauggugaucgggauugucucccugaugcuccaaaucggaaacauuaucucuauauggguuucacacaguauccagacugguaaucagcaucaggccgagccuuguaaccaaagcauuaucacguacgaaaauaacaccugggugaaucagacauauguaaacauuuccaauacuaacuuccuuaccgagaaagcuguggcaucugucacacuggccggcaauucgucauugugcccaaucagcgggugggcgguguacaguaaggacaacggaauaagaauuggcuccaaaggugauguuuuugugaucagggaaccguucauuucuuguagccacuuagagugccggaucuuuuuccugacccagggggcucuacucaaugacaagcauuccaacggaacugucaaagaucgcucaccccaccgaacacugaugaguuguccugugggcgaagccccaagccccuauaauucucguuuugaguccguagcauggucagccagcgcuugccaugacggcaccaguuggcuuacgaucgggauuucuggaccugauaacggugcaguugccgugcugaaguacaacggcauaaucacugacaccauuaaguccuggagaaauaacaucaugaggacacaggagagcgaaugugcuugcgucaaugggucguguuucacugugaugaccgauggaccaucuaacggccaagccuccuauaaaauauuucggauugagaaggguaaaguggucaagucagcggaauugaaugcacccaacuaccacuaugaggagugcaguuguuacccugacgccggggaaaucacaugcguuugccgcgauaauuggcacggaagcaacagaccauggguguccuucaaucagaaccucgaguacaggaucggcuauauuuguucuggcguauuuggggacaauccgcggcccaacgauggaaccgguagcugcggcccugugucaccaaaaggggcuuacggaaucaagggcuucaguuuuaaguaugguaauggggucuggauuggccgcacgaaauccacuaacagccgaucuggauucgaaaugauaugggaccccaauggcuggacagggaccgauucaaacuuuagugugaagcaggacaucguugccauuacugacuggagcggauacuccgguucuuucgugcagcauccugagcugacaggccuggauuguaucagaccaugcuucugggucgaacucaucagggggcggcccaaagagucgaccauuuggacgagcggauccucaauaaguuuuuguggcgugaacucugacaccguagguuggagcuggccggauggggcagaguuaccuuucacaaucgacaaguga

SEQ ID NO: 148170 - RNA, 1350 nt, Artificial Sequence
  derived and/or modified sequence opt3 from neuraminidase__InfluenzaA__BAK23415
augaaccccaaucagaagaucauuaccauaggcagcgugugcaugaucauugggaucgucucccugaugcuccaaauuggaaacaugaucucuauauggguuggucacucaauccagacaggcaaucagugucaugccgagccuauuaguaacacuaaauucccaacggaaaaggcugcagccagcgugacccuugcgggaaauuccucucugugcccgaucucggggugggcuguauacucaaaagacaacagcauuagaaucggcaguaggggugauguguuugucauacgggagcccuucauuuccuguucucacuuggaaugccgcacauuuuucuuaacucagggggcccugcuaaaugacaagcauagcaacggaaccgugaaagaucgauccccucaccguacacucaugucauguccaguuggcgaggcacccaguccuuauaauagcagauuugaaucuguggccugguccgcuucagcaugccaugacggcaccagcuggcugacuaucgggauuaguggaccagauaacggugccgucgcugugcuuaaguacaauggcaucaucacagacaccauuaagucuuggaggaacaauauacugcggacgcaagaguccgagugugccugcaucaacgggagcuguuucacuguaaugaccgauggacccucgucuggccaggcguccuauaaaauuuuuaagauggaaaaagguaagguugugaaaucagucgaguuggacgcaccuaauuaccacuaugaagagugcaguuguuacccagaugccggggagaucacaugcgugugccgcgacaacuggcacggaagcaacagaccguggguguccuucaaucagaaccucgaauaucagauaggcuacauuuguucuggcgucuuuggggauaaucccaggccuaacgacggaacugguagcugcggcccaguuucacccaauggggcuuacggagugaagggcuucaguuuuaaguaugguaacgggguauggaucggccggaccaaauccacaaauagccgcucuggauucgagaugaucugggauccuaacggcuggaccgggacggacucaaguuuuagcgugaagcaagacauugucgccaucacugauugguccggauacucugguucguucgugcagcauccagaacugacaggccuggacuguauucgacccugcuucuggguugagcucauaagagggaggccgaaagaaagcaccaucuggacuuccggaucaaguauuucuuuuuguggcgugaauagcgauacagucuccuggucauggccugacggugcagaguuacccuucaccaucgauaaguga

SEQ ID NO: 148171 - RNA, 1350 nt, Artificial Sequence
  derived and/or modified sequence opt3 from neuraminidase__InfluenzaA__BAK23416
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuaucggcauuucugggccugauaacggagcaguggccguacugaaguacaaugguaucaucacagacaccauuaaguccuggaggaacaauauauugcggacgcaggagagcgagugugcuugcguuaacggcucguguuucacugugaugaccgaugggccaucuuccggacaggccucauauaaaaucuuuaagauggaaaaaggcaaggucgugaaaaguguggagcucgacgcgcccaauuaccauuaugaagagugcagcuguuacccugaugcaggagagauuacaugcgucugccgcgacaacuggcacggguccaacagaccauggguuucuuucaaucagaaccuggaauaucaaaucggauacauauguagcggcguguuuggcgauaauccgaggcccaacgacgggacuggaucaugcgguccugccaguccaaauggcgcuuacgggguaaagggauucuccuuuaaguauggcaacgguguguggauugggcggaccaaaagcacaaauucucgcucaggcuucgagaugaucugggaucccaacggauggaccggcacggacaguagcuuuuccgucaagcaggacaucguggccauuacugauuggucuggguacucggguagcuucguucagcacccugaacugacaggucucgacuguauccgaccaugcuucuggguggaguuaauuagaggcaggcccaaagaauccaccauauggacuucagggaguucuaucagcuuuuguggagucaauuccgauacagugucauggagcuggccggacggcgcagagcugccuuucaccauugauaaguga

SEQ ID NO: 148172 - RNA, 1350 nt, Artificial Sequence
  derived and/or modified sequence opt3 from neuraminidase__InfluenzaA__BAK23417
augaaccccaaucagaagaucauuaccauaggcagcaucugcauggugauugggaucgucucccugaugcuccaaauuggaaacaugaucucuauauggguuucacacaguauccagacagguaaucagugucagagcgagccuauuuccaacacuaaauuccuuacggaaaaggccguggcuucuguaacccuggcaggcaauucgucauugugcccaaucagcgggugggccguguacaguaaagacaacuccauuagaaucggaucuaggggcgaugucuuugugauacgggagccguucauuagcuguucccauuuagaaugccgcacauuuuuccugacucaaggugcgcuacucaaugacaagcacucaaacgggaccguuaaagaucgaaguccccaucguacacugaugagcuguccugugggagaggcuccaucucccuauaauuccagauuugaaucagucgccuggagcgcaagugccugccacgacggcaucucuuggcuuaccauuggcaucuccgggccugauaacggagcuguggcaguacugaaguacaaugguaucauuacugacacaauaaagagcuggaggaacaauaucuugcggacccaggagucggagugugccugcguuaacggcucuuguuucacggugaugacugaugggccauccucaggacaggcuaguuauaaaauuuuuaagauggaaaaaggcaaggucgugaaaagcguggagcucgacgcccccaauuaccauuaugaagagugcuccuguuacccugaugcgggugagauaaccugcgucugccgcgacaacuggcacgggucuaacagaccauggguuagcuucaaucagaaccuggaauaucaaaucggauacauuuguucaggcguguuuggcgauaauccgaggcccaacgacgggacaggaaguugcgguccuguauccccaaauggcgcauacggggugaagggauucagcuuuaaguauggcaacggugucuggaucgggcggacuaaaucuaccaauucacgcaguggcuucgagaugaucugggaucccaacggauggacaggcaccgacagcuccuuuucugugaagcaggacauuguugccaucacggauuggucgggguacagcggauccuucgugcagcacccugaacugacuggucucgacuguauucgaccaugcuucugggucgaguuaauaagaggcaggcccaaagaaucaacaaucuggaccagugggucuagcauuuccuuuuguggagugaauggcgauacuguaucauggagcuggccggacggugcugagcugccuuucacaaucgauaaguga

SEQ ID NO: 148173 - RNA, 1350 nt, Artificial Sequence
  derived and/or modified sequence opt3 from neuraminidase__InfluenzaA__BAK23418
augaaccccaaucagaccaucauuacaauaggcagcaucugcauggugauugggaucgucucccugaugcuccaaauuggaaacaugaucucuauauggguuucacacaguauccagacugguaaucagugucaggccgagccuauuagcaacacgaaguuccuuaccgaaaaagcuguggcauccguaacacuggccggcaauucuucguugugcccaaucucagggugggcgguguacagcaaggacaacaguauuagaaucggauccaggggcgaugucuuugugauacgggagccguucauuucuuguagccauuuagaaugccgcaccuuuuuccugacucaaggugcucuacucaaugacaaacacuccaacgggacaguuaaggaucgaucaccccaucguacccugaugaguuguccugugggagaggccccaagccccuauaauucuagauuugaauccgucgcauggucagccagcgcuugccacgacggcacuuccuggcuuacaaucggcauuucugggccugauaacggagcaguggccguacugaaauacaaugguaucaucaccgacacgauuaaguccuggaggaacaauauauugcggacucaggagagcgagugugcuugcguuaacggcucguguuucaccgugaugacagaugggccaucuuccggacaggccucauauaagaucuuuaaaauggaaaagggcaaagucgugaagaguguggagcucgacgcgcccaauuaccauuaugaagagugcagcuguuacccugaugcaggagagauuacuugcgucugccgcgacaacuggcacggguccaacagaccauggguuucuuucaaucagaaccuggaauaucaaaucggauacauauguagcggcguguuuggcgauaauccgaggcccaacgacgggaccggaucaugcgguccuguaaguccaaauggcgccuacggggugaaaggauucuccuuuaaguauggcaacggugucuggauugggcggacaaagagcaccaauucucgcucaggcuucgagaugaucugggaucccaacggauggacgggcacugacaguagcuuuuccgugaaacaggacaucguugcuauuacagauuggucuggguacucggguagcuucgugcagcacccugaacugaccggucucgacuguauccgaccaugcuucugggucgaguuaauuagaggcaggcccaaggaauccacuauauggacaucagggaguucuaucagcuuuuguggagugaauagugauaccguaucauggagcuggccggacggcgccgagcugccuuucacgauugauaaauga

SEQ ID NO: 148174 - RNA, 1350 nt, Artificial Sequence; identical to SEQ ID NO: 138593
  derived and/or modified sequence opt3 from neuraminidase__InfluenzaA__BAK23420

SEQ ID NO: 148175 - RNA, 1350 nt, Artificial Sequence; identical to SEQ ID NO: 138593
  derived and/or modified sequence opt3 from neuraminidase__InfluenzaA__BAK23421

SEQ ID NO: 148176 - RNA, 1350 nt, Artificial Sequence
  derived and/or modified sequence opt3 from neuraminidase__InfluenzaA__BAK23422
augaaccccaaucagaagaucauuaccauaggcagcgugugcauggucaucgggauuguuucccugaugcuccaaaucggaaacaugauuucuaucugggugggucacucaauacagacaggcaaucagugucaugccgagccuaucaguaacacuaaauucccaacggaaaaggcugcagccagcguaacccuugcgggaaauuccucucugugcccgauuucggggugggcuguguacucaaaagacaacagcaucagaauuggcaguaggggugaugucuuugugauccgggagcccuucauauccuguucucacuuggaaugccgcacauuuuucuuaacucagggggcccugcuaaaugacaagcauagcaacggaaccguuaaagaucgauccccucaccguacacucaugucauguccagugggcgaggcacccaguccuuauaauagcagauuugaaucugucgccugguccgcuucagcaugccaugacggcaccagcuggcugacuauugggaucaguggaccagauaacggugccguggcuguacuuaaguacaauggcauuaucacagacaccaucaagucuuggaggaacaauauucugcggacgcaagaguccgagugugccugcguuaacgggagcuguuucacugugaugaccgauggacccucgucuggccaggcguccuauaaaauauuuaagauggaaaaagguaaggucgugaaaucaguggaguuggacgcaccuaauuaccacuaugaagagugcaguuguuacccagaugccggggagaucacaugcgucugccgcgacaacuggcacggaagcaacagaccguggguuuccuucaaucagaaccucgaauaucagauuggcuacaucuguucuggcguguuuggggauaaucccaggccuaacgacggaacugguagcugcggcccaguaucacccaauggggcuuacggagugaagggcuucaguuuuaaguaugguaacggggucuggauaggccggaccaaauccacaaauagccgcucuggauucgagaugauuugggauccuaacggcuggaccgggacggacucaaguuuuagcgugaagcaagacaucguugccaucacugauugguccggauacucugguucguucgugcagcauccagaacugacaggccuggacuguauucgacccugcuucugggucgagcucaucagagggaggccgaaagaaagcaccauuuggacuuccggaucaaguauaucuuuuuguggcgugaauagcgauacaguauccuggucauggccugacggugcagaguuacccuucaccaucgauaaguga

SEQ ID NO: 148177 - RNA, 1350 nt, Artificial Sequence
  derived and/or modified sequence opt3 from neuraminidase__InfluenzaA__BAK23423
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcacuacgaaauuccuuaccgaaaaggcuguggcauccguaacacuggccggcaacucuucguugugcccaaucucagggugggcgguguacagcaaagacaauaguauuagaaucggaccgaggggcgaugucuuugugauacgggagcccuucauuuccuguucucauuuagaaugccgcaccuuuuuccugacucaaggugcucuacucaacgacaagcacagcaaugggacaguuaaagaucgauccccucaucguacccugaugucauguccagugggagaggcccccaguccuuauaacagcagauuugaaucugucgcaugguccgccucagcuugccacgacggcaucagcuggcuuacuauuggcaucagugggccagauaauggagcaguggccguacugaaguacaacgguaucauuacagacaccauaaagucuuggaggaauaacaucuugcggacgcaggaguccgagugugcuugcguuaauggcagcuguuucacugugaugaccgaugggcccucgucuggacaggccuccuauaaaauuuuuaagauggaaaaaggcaaggucgugaaaucaguggagcucgacgcgccuaacuaccauuaugaagagugcaguuguuacccagaugccggugagaucacaugcgucugccgcgacaauuggcacgggagcaacagaccguggguuuccuucaaccagaaucuggaauaucaaauaggauacauuuguucuggcguguuuggcgauaaccccaggccuaaugacgggacuggaagcugcgguccaguaucacccaacggcgcauacggggugaagggauucaguuuuaaguauggcaauggugucuggaucgggcggaccaaauccacaaacagccgcucuggcuucgagaugaucugggauccuaauggauggaccggcacggacucaaguuuuagcgugaagcaggacauuguugcuaucacugauugguccggguacucuggaucguucgugcagcacccagaacugacaggucucgacuguauucgacccugcuucugggucgaguuaauaagaggcaggccgaaagaaagcaccaucuggacuuccgggucaaguauuucuuuuuguggagugaacagcgauacaguauccuggucauggccugacggcgccgagcugcccuucaccaucgauaaguga

SEQ ID NO: 148178 - RNA, 1350 nt, Artificial Sequence
  derived and/or modified sequence opt3 from neuraminidase__InfluenzaA__BAK23424
augaaccccaaucagaagaucauuaccauaggcagcaucugcauggugauugggaucgucucccugaugcuccaaauuggaaacaugaucucuauauggguuucacacaguauccagacagguaaucagugucagggcgagccuauuagcaacacuaaauuccuuacggaaaaggccguggcuuccguaacccuggcaggaaauucuucguugugcccaaucucagggugggccguguacagcaaagacaacaguauuagaaucggcuccaggggugaugucuuugugauacgggagccguucauuucuuguagccauuuagaaugccgcacauuuuuccugacucaaggggcgcuacucaaugacaagcacuccaacggaaccguuaaagaucgaucaccccaucguacacugaugaguuguccugugggcgaggcuccaagccccuauaauucuagauuugaauccgucgccuggucagcaagcgccugccacgacggcaccaguuggcuuacuaucgggauuucuggaccugauaacggugcuguggcaguacugaaguacaauggcaucaucacagacaccauuaaguccuggaggaacaauauauugcggacgcaggagagcgagugugccugcguuaacgggucguguuucacugugaugaccgauggaccaucuuccggccaggcuucauauaaaaucuuuaagauggaaaaagguaaggucgugaaaaguguggagcucgacgcccccaauuaccauuaugaagagugcagcuguuacccugaugcgggggagauuacaugcgucugccgcgacaacuggcacggauccaacagaccauggguuucuuucaaucagaaccuggaauaucaaaucggcuacauauguagcggcguguuuggggauaauccgaggcccaacgacggaacugguucaugcggcccuguauucaguaauggggcauacggagugaagggcuuuuccuucaaguaugguaacggggucuggauuggccggaccaaaagcacaaauucucgcucaggauuugagaugaucugggauccaaacggcuggaccgggacggacaguagcuucuccggaaagcaggacaucguggccauuacugauuggucugguuacucgggcagcuucguucagcaccccgaacugacagggcucgacuguauccgaccuugcuuuuggguggaguuaauuagaggaaggccaaaagaauccaccauauggacuucaggcaguucuaucagcuucuguggugucaauuccgauacagugucauggagcuggcccgacggggcugagcugccguuuaccauugauaaguga

SEQ ID NO: 148179 - RNA, 1350 nt, Artificial Sequence
  derived and/or modified sequence opt3 from neuraminidase__InfluenzaA__BAK23425
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaucaguuggcuuaccauuggcaucucugggccugauaacggagcaguggccguacugaaguacaaugguaucauuacugacacaauaaaguccuggaggaacaauaucuugcggacccaggagagcgagugugcuugcguuaacggcucguguuucacggugaugacugaugggccaucuuccggacaggccucauauaaaauuuuuaagauggaaaaaggcaaggucgugaaaaguguggagcucgacgcgcccaauuaccauuaugaagagugcagcuguuacccugaugccggugagauaaccugcgucugccgcgacaacuggcacggguccaacagaccauggguuucuuucaaucagaaccuggaauaucaaaucggauacauuuguagcggcguguuuggcgauaauccgaggcccaacgacgggacaggaucaugcgguccuguaaguccaaauggcgcauacggggugaagggauucuccuuuaaguauggcaacggugucuggaucgggcggacuaaaagcaccaauucucgcucaggcuucgagaugaucugggaucccaacggauggauuggcacagacaguagcuuuuccgugaagcaggacaucguugcuauuaccgauuggucuggguacucgggauccuucgugcagcacccugaacugacgggucucgacuguauacgaccaugcuucugggucgaguuaaucagaggcaggcccaaagaauccacuauuuggacaucagggaguucuaucagcuuuuguggagugaauagcgauaccguaucauggagcuggccggacggcgccgagcugccuuucacuaucgauaaguga

SEQ ID NO: 148180 - RNA, 1350 nt, Artificial Sequence
  derived and/or modified sequence opt3 from neuraminidase__InfluenzaA__BAK23426
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauucuuuacggaaaaggcuguggcauccguaacccuugccggcaauucuucgcugugcccaaucucagggugggcgguguacagcaaagacaacaguauuagaaucggauccaggggcgaugucuucauaauucgggagccguuuaucucuuguagccauuuggaaugccgcacauucuuuuuaacucaaggugcucugcuaaaugacaagcacuccaacgggaccgugaaagaucgaucaccccaucguacacucaugaguuguccuguuggagaggccccaagccccuauaauucuagauucgaauccguggcauggucagccagcgcuugccacgacggcaccaguuggcugacuauuggcaucucugggccugauaacggagcagucgccgugcuuaaguacaaugguaucauuacagacaccauaaaguccuggaggaacaauauccugcggacgcaggagagcgagugugcuugcguaaacggcucguguuuuacuguuaugaccgaugggccaucuuccggacaggccucauauaaaauuuucaagauggaaaaaggcaagguggucaaaaguguggaguuggacgcgcccaauuaccauuaugaagagugcagcuguuacccugaugcaggagagaucacaugcgugugccgcgacaacuggcacggguccaacagaccaugggucucuuuuaaucagaaccucgaauaucaaauaggauacauuuguagcggcguuuucggcgauaauccgaggcccaacgacgggacuggaucaugcgguccugugaguccaaauggcgccuacgggguaaagggauuuuccuucaaguauggcaacgguguguggaucgggcggaccaaaagcacaaauucucgcucaggcuuugagaugaucugggaucccaacggauggaccggcacggacaguagcuucuccgucaagcaggacauuguggcuaucacugauuggucuggguacucggguagcuucguucagcacccugaacugacaggucuggacuguauucgaccaugcuuuuggguggagcucauaagaggcaggcccaaagaauccaccaucuggacuucagggaguucuauuagcuucuguggagucaauuccgauacagugucauggagcuggccggacggcgccgaguuaccuuuuaccaucgauaaguga

SEQ ID NO: 148181 - RNA, 1350 nt, Artificial Sequence; identical to SEQ ID NO: 148179
  derived and/or modified sequence opt3 from neuraminidase__InfluenzaA__BAK23427

SEQ ID NO: 148182 - RNA, 1350 nt, Artificial Sequence
  derived and/or modified sequence opt3 from neuraminidase__InfluenzaA__BAK23428
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuaucggcauuucugggccugauaacggagcaguggccguacugaaguacaaugguaucaucacagacaccauuaaguccuggaggaacaauauauugcggacgcaggagagcgagugugcuugcguuaacggcucguguuucacugugaugaccgaugggccaucuuccggacaggccucauauaaaaucuuuaagauggaaaaaggcaaggucgugaaaaguguggagcucgacgcgcccaauuaccauuaugaagagugcagcuguuacccugaugcaggagagauuacaugcgucugccgcgacaacuggcacggguccaacagaccauggguuucuuucaaucagaaccuggaauaucaaaucggauacauauguagcggcguguuuggcgauaauccgaggcccaacgacgggacuggaucaugcgguccuguaaguccaaauggcgccuacggggugaagggauucuccuuuaaguauggcaacggugucuggauugggcggaccaaaagcacaaauucucgcucaggcuucgagaugaucugggaucccaacggauggaccggcacggacaguagcguguccguuaagcaggacaucguggcuauuacugauuggucuggguacucggguagcuuuguccagcacccugaacugacaggucucgacuguauccgaccaugcuucagaguggaguuaauuaggggccggcccaaagaauccaccauauggacuucagggaguucuaucagcuucuguggaguaaauuccgauacaguuucauggagcuggccggacggcgccgagcugccuuuuaccauugauaaguga

SEQ ID NO: 148183 - RNA, 1350 nt, Artificial Sequence; identical to SEQ ID NO: 148179
  derived and/or modified sequence opt3 from neuraminidase__InfluenzaA__BAK23429

SEQ ID NO: 148184 - RNA, 1350 nt, Artificial Sequence
  derived and/or modified sequence opt3 from neuraminidase__InfluenzaA__BAK23430
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaucaguuggcuuaccauuggcaucucugggccugauaacggagcaguggccguacugaaguacaaugguaucauuacugacacaauaaaguccuggaggaacaauaucuugcggacccaggagagcgagugugcuugcguuaacggcucguguuucacggugaugacugaugggccaucuuccggacaggccucauauaaaauuuuuaagauggaaaaaggcaaggucgugaaaaguguggagcucgacgcgcccaauuaccauuaugaagagugcagcuguuacccugaugccggugagauaaccugcgucugccgcgacaacuggcacggguccaacagaccauggguuucuuucaaucagaaccuggaauaucaaaucggauacauuuguagcggcguguuuggcgauaauccgaggcccaacgacgggacaggaucaugcgguccuguaaguccaaauggcgcauacggggugaagggauucuccuuuaaguauggcaacggugucuggaucgggcggacuaaaagcaccaauucucgcucaggcuucgagaugaucugggaucccaacggauggauuggcacagacaguagcuuuuccgugaagcaggacaucguugcuauuaccgauuggucuggguacucgggauccuucgugcagcacccugaacugacgggucucgacuguaugcgaccaugcuucugggucgaguuaauaagaggcaggcccaaagaauccacuaucuggacaucagggaguucuauuagcuuuuguggagugaauagcgauaccguaucauggagcuggccggacggcgccgagcugccuuucacuaucgauaaguga

SEQ ID NO: 148185 - RNA, 1350 nt, Artificial Sequence
  derived and/or modified sequence opt3 from neuraminidase__InfluenzaA__BAK23431
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuaucggcauuucugggccugauaacggagcaguggccguacugaaguacaaugguaucaucacagacaccauuaaguccuggaggaacaauauauugcggacgcaggagagcgagugugcuugcguuaacggcucguguuucacugugaugaccgaugggccaucuuccggacaggccucauauaaaaucuuuaagauggaaaaaggcaaggucgugaaaaguguggagcucgacgcgcccaauuaccauuaugaagagugcagcuguuacccugaugccggugagauuacaugcgucugccgcgacaacuggcacggguccaacagaccauggguuucuuucaaucagaaccuggaauaucaaaucggauacauauguagcggcguguuuggcgauaauccgaggcccaacgacgggacuggaucaugcgguccuguaaguccaaauggcgcauacggggugaagggauucuccuuuaaguauggcaacggugucuggauugggcggaccaaaagcacaaauucucgcucaggcuucgagaugaucuggggacccaacggcuggaccgggacggauaguagcuuuuccgugaagcaggacaucguugcuauuacugacuggucuggauacucggguagcuucgugcagcacccugaacugacaggccucgauuguauccgaccaugcuucugggucgaguuaauuagagggaggcccaaagaauccaccauauggacuucaggaaguucuaucagcuuuuguggcguaaauuccgacacagugucauggagcuggccggauggugccgagcugccuuucaccauugacaaguga

SEQ ID NO: 148186 - RNA, 1350 nt, Artificial Sequence; identical to SEQ ID NO: 148179
  derived and/or modified sequence opt3 from neuraminidase__InfluenzaA__BAK23432

SEQ ID NO: 148187 - RNA, 1350 nt, Artificial Sequence; identical to SEQ ID NO: 148179
  derived and/or modified sequence opt3 from neuraminidase__InfluenzaA__BAK23433

SEQ ID NO: 148188 - RNA, 1410 nt, Artificial Sequence
  derived and/or modified sequence opt3 from neuraminidase__InfluenzaA__BAM65748
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuuccaauuugcgcuaggccaggggacgacucucaauaacguccauucaaaugauaccgugcacgaccgaacaccauaccguacucugcuuaugaacgaacugggaguucccuuccauuugggcaccaaacaggugugcauugcuuggagcaguuccucuugucacgaugguaaggccuggcuccaugucugcgugacaggggacgauaagaaugcaaccgccagcuuuaucuauaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuucauugaggagggaaagaucgugcacacaucaaccuuaagcgguagugcccaacacgucgaagagugcucuugcuacccucgguauccaggcguucgcugugugugcagagauaacuggaaaggguccaacaggccgauaguagacauuaauaucaaggacuacagcaucgugucgucuuacgucuguuccggacuggugggcgauacgccccggaaaaccgacucaaguagcuccucucauugccuugauccuaacaaugaagagggugggcacggaguuaagggcugggcuuuugacgauggcaacgacguguggauggggcgcacaauuagcgaaaaaucacgauugggauaugagacuuucaaggucaucgguggcuggaguaauccaaacuccaaaagccagauuaauagacaggugauaguagauauggggaacaggucuggauacucaggcaucuuuaguguugaggguaagagcuguauuaaucggugcuucuauguggaacugauccgugggcgcaaggacgagaccgaaguccuauggacauccaacucuaucguggucuucuguggcacuucgggaaccuacggcacagggagcuggcccgauggagccgacauuaaacucauguccauauga

SEQ ID NO: 148189 - RNA, 1350 nt, Artificial Sequence
  derived and/or modified sequence opt3 from neuraminidase__InfluenzaA__BAM85817
augaaccccaaucagaagaucauuaccauaggcagcaucugcauggugacagggauugucucccugaugcuccaaaucggaaacaugauuucuaucuggguuucacacaguauacauacugguaaucagcaccagagcgagccuaucuccaacacgaauuuccuuaccgaaaaagccguggcuucuguaaagcuggcaggcaacucgucauuguguccaauuaaugggugggccguguacagcaaagacaacaguaucagaauuggauccaagggcgaugucuuugugaucagggagccguucauaucuugcagccauuuagaaugucggacauuuuuccugacucagggugcgcuacucaaugacaaacacuccaacgggaccguuaaggaucgcucaccccaucgaacacugaugaguugcccugugggagaggcuccaagccccuauaauucucguuuugaauccgucgccuggucagcaagcgccugucacgacggcaccaguuggcuuacuauuggcaucucugggccugauaacggagcuguggcaguacugaaguacaaugguauuaucacagacaccaucaaauccuggagaaacaauauuuugaggacgcaagagagcgagugcgccuguguuaacggcucgugcuucacugugaugaccgaugggccaucuaacggacaggcuucccacaagauauuuaaaauggaaaagggcaaagucgugaagucaguggagcucgacgcccccaauuaucauuacgaagaguguaguugcuauccuaacgcgggugagaucacaugugucugccgggauaauuggcacgggagcaaccgcccauggguuuccuucaaucagaaccuggaauaccagauuggauauaucugcucuggcguguuuggcgacaauccgagacccaacgaugggacuggaagcugugguccuguaucaaguaauggcgcauacggggugaagggauucuccuuuaaauacggcaacggugucuggauagggaggaccaagagcacaaauucucggucaggcuucgagaugauuugggacccaaacggauggaccgaaacggauaguagcuuuuccgugaaacaagacaucguugccaucacugacuggucuggcuauucggggagcuucgugcagcaucccgagcugacaggacucgauugcauucgcccuuguuucugggucgaauuaauccgagguagaccaaaggaguccaccauuuggacuucaggcaguucuauauccuuuugcggggugaauagcgacacaguaggauggucauggcccgauggcgcugagcugccguucaccaucgacaaauga

SEQ ID NO: 148190 - RNA, 1350 nt, Artificial Sequence
  derived and/or modified sequence opt3 from neuraminidase__InfluenzaA__BAM85818
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagaaacacuaauuuccuuacggaaaacgcuguggcaagcguaacccuggccggcaauuccucuuuguguccaaucagggggugggcggugcacucgaaagacaacucaauucggaucggaagcaagggcgaugucuuugugauacgcgagccguucauuaguugcucccauuuagaaugucgaacauuuuuccugacucaaggugcucuacucaaugacaaacacucuaacgggaccguuaaggaucguagcccccauagaacacugauguccugcccugugggagaggccccaucacccuacaauaguagguuugaaagcgucgcauggucugccuccgcuugucacgacggcaccucauggcuuacuaucggcauuagcgggccugauaacggagcaguggccguacugaaauauaaugguaucaucacagacaccauuaagaguuggcggaacaauauauugcgcacgcaggagucugagugcgcuuguguuaacggcuccugcuucacugugaugaccgaugggccaagcaacggacaggccucguacaagaucuuuaaaauggaaaagggcaaagucgugaagucuguggagcucaaugcgcccaacuaucacuacgaagaguguuccugcuauccugacgcaggagagauuaucugugucugcagagauaauuggcaugggucaaacaggccauggguuaguuucaaucagaaccuggaauaccaaauaggauauauuugcagcggcguguuuggcgacaauccgcggcccaacgaugggacaggauccugugguccuguaucuccaaauggcgccuacgggaucaaaggauucagcuuuaaguacggcaacgguguguggaucgggcgcacuaagucaaccaauagucgauccggcuucgagaugauuugggaccccaacggauggacaggcaccgauagcaauuuuucugucaaacaggacaucguggcuauuacggacuggucaggguauagugguagcuucguucagcacccugaacugacuggucucgauugcauaagaccauguuucuggguggaguuaaucaggggccggcccaaggaauccacaauuuggaccucugggucgagcaucuccuuuugcggagucaacucagacacugugaguuggucuuggccggauggcgccgagcugccuuucacaaucgacaaauga

SEQ ID NO: 148191 - RNA, 1350 nt, Artificial Sequence
  derived and/or modified sequence opt3 from neuraminidase__InfluenzaA__BAM85819
augaaccccaaucagaagaucauuaccauaggcagcaucugcauggugauugggaucgucucccugaugcuccaaauuggaaacaugaucucuauauggguuucacacaguauccagacagguaaucagaaccagguggagccuauuaucaauacuaacuuccuuacggaaaaagccguagcuagcauuacccuggcaggcaauuccucuuuguguccaaucagagggugggccauacauucgaaggacaacucaauuaggaucggaagcaaaggcgauguguuugucauucgggagccguucaucaguugcucccacuuagaaugucgcacauuuuuccugacucaaggugcgcuacucaaugacaagcauucuaacgggaccgugaaagaucgaagcccccaccguacacugauguccugcccuguuggagaggcuccaucacccuacaauaguagauuugaaagcguggccuggucugcauccgccugucaugacggcaccucauggcuuacuaucggcauuagcgggccugauaacggagcugucgcagugcugaaguauaaugguauaaucacagacaccauuaagaguuggaggaacaauaucuugcggacgcaggagucugagugcgccuguguaaacggcuccugcuucacuguuaugaccgaugggccaagcgacggacaggcuucguacaaaauauuuaagauggaaaaaggcaaggugauuaaaucugucgagcucgaugcccccaacuaucacuacgaagaguguuccugcuauccugacgcgggugagaucacaugugugugccgcgauaauuggcacgggucaaacagaccaugggugaguuucaaucagaaccuggaauaccaaaucggauauauuugcagcggcgucuuuggcgacaauccgaggcccaacgaugggacuggauccugugguccuguuucucauaauggcgcauacggggugaagggauucagcuuuaaguacggcaacgguguauggaucgggcggaccaaaucaccaaauagucgcuccggcuucgagaugauuugggaccccaacggauggagcgaaacagacucuucauuuagugugaagcaggauauagucgccaucaccgacuggagcggcuauuccgggucuuucgugcagcacccugagcugacgggacucgauugcauucgaccauguuucuggguugaauuaaucagagguaggcccaaagagucgacuguguggacaagcggcuccucaaucaguuuuugcggggucucuagcgacaccguguccuggucauggccggauggagcugagcugccuuucacuauugacaaguga

SEQ ID NO: 148192 - RNA, 1350 nt, Artificial Sequence
  derived and/or modified sequence opt3 from neuraminidase__InfluenzaA__BAM85820
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagcaacacuaauuuccuuacggaaaaagcuguggcauccguaacccuggccggcaacucuucguuguguccaaucagagggugggcggugcacucaaaggacaauagcauuaggaucggaaguaaaggcgaugucuuugugauacgggagccguucauuuccugcucucauuuagaaugucgcacauuuuuccugacucaaggugcucuacucaacgacaagcacagcaaugggaccguuaaagaucgaucaccccaucguacacugauguccugcccugugggagaggccccaagucccuacaacagcagauuugaaucugucgcaugguccgccucagcuugucacgacggcaccagcuggcuuacuaucggcauuagugggccugauaauggagcaguggccguacugaaguauaacgguaucaucacagacaccauuaagucuuggaggaauaacauauugcggacgcaggaguccgagugcgcuuguguuaauggcagcugcuucacugugaugaccgaugggccaucgaacggacaggccucuuacaaaaucuuuaagauggaaaaaggcaaggucgugaaauccguggagcucgacgcgcccaacuaucacuacgaagaguguucaugcuauccugaugccggugagauuacaugugucugccgcgacaauuggcaugggaguaacagaccauggguuagcuucaaucagaaccuggaauaccaaaucggauauauaugcuccggcguguuuggcgauaauccgaggcccaacgacgggacuggaucuugugguccuguaagcccaaauggcgcauacggggugaagggauucucauuuaaguacggcaacggugucuggauugggcggaccaaaaguacaaauucccgcagcggcuucgagaugaucugggaucccaacggauggaccggcacggacucuucauuuagugugaagcaggacaucguugcuauuacugauuggagcggguauuccggaucuuucgugcagcacccugaacugacaggucucgacugcauccgaccauguuucugggucgaguuaauuagaggcaggcccaaagaaucgaccauauggacuagcggguccucaaucaguuuuugcggaguaaauucugauacagugagcugguccuggccggacggcgccgagcugccuuucaccauugauaaguga

SEQ ID NO: 148193 - RNA, 1350 nt, Artificial Sequence; identical to SEQ ID NO: 137024
  derived and/or modified sequence opt3 from neuraminidase__InfluenzaA__BAM85821

SEQ ID NO: 148194 - RNA, 1350 nt, Artificial Sequence
  derived and/or modified sequence opt3 from neuraminidase__InfluenzaA__BAM85822
augaaccccaaucagaagaucauuaccauaggcagcaucugcauggugacagggauugucucccugaugcuccaaaucggaaacaugauuucuaucuggguuucacacaguauacauacugguaaucagcaccagagcgagccuaucuccaacacgaauuuccuuaccgaaaaagccguggcuucuguaaagcuggcaggcaacucgucauuguguccaauuaaugggugggccguguacagcaaagacaacaguaucagaauuggauccaagggcgaugucuuugugaucagggagccguucauaucuugcagccauuuagaaugucggacauuuuuccugacucagggugcgcuacucaaugacaaacacuccaacgggaccguuaaggaucgcucaccccaucgaacacugaugaguugcccugugggagaggcuccaagccccuauaauucucguuuugaauccgucgccuggucagcaagcgccugucacgacggcaccaguuggcuuacuauuggcaucucugggccugauaacggagcuguggcaguaguuaaguacaaugguauuaucacagacaccaucaaauccuggagaaacaauauucugaggacgcaagagagcgagugcgccugugugaacggcucgugcuucacugucaugaccgaugggccaucuaacucccaggcuucacacaagauauuuaaaauggaaaagggaaaaguggugaagagugucgaguuggacgcccccaauuaucauuacgaagaguguagcugcuauccugaugcgggcgagaucacauguguuugccgggacaacuggcacgguuccaaucgcccaugggugucuuucaaccagaaucucgaauaccagauuggguauaucugcagcggaguauuuggcgauaacccgagacccaaugacggcacugggucauguggaccugugaguuccaacggugcauacggcgucaagggguucagcuuuaaauacggaaauggcguguggauagguaggaccaagucuacaaacucacggaguggguucgagaugauuugggauccaaauggcuggaccgaaacggacagcuccuuuucuguuaaacaagacaucguggccaucacugauuggucgggauauagcggcuccuucguccagcaucccgagcugacagggcuggacugcauucgcccuuguuucuggguggaacucauccgaggaagaccaaaggagucaaccauuuggacaagugguucuagcauauccuuuugcggcguaaacucagauacuguuggguggagcuggcccgacggagcugaguuaccguucaccaucgauaaauga

SEQ ID NO: 148195 - RNA, 1410 nt, Artificial Sequence
  derived and/or modified sequence opt3 from neuraminidase__InfluenzaA__BAM85823
augaaccccaaucagaagaucaccacaauuggcagcauaugcauggugaucgggauugucucccugaugcuccaaaucggaaacauuaucucuauauggguuucacacaguauccagacugguaaucagcaucaggccggcccuuguaaccaaagcauuaucacguacgagaauaacaccugggugaaucagacauauguaaacauuuccaauacuaacuuccuuaccgagaaaacaguggcuucugucacccuggcaggaaauucgucauugugcccaaucagcgggugggccguguacaguaaggacaacggcauaagaauugguuccaaaggggauguuuuugugaucagggaaccguucauuucuuguagccacuuagaaugccggaccuuuuuccugacacagggagcgcuacucaaugacaagcauuccaacggcaccgucaaagaucgcucaccccaccgaacgcugaugaguuguccugugggcgaggcuccaagccccuauaauucucguuuugaauccguagccuggucagcaagcgccugccaugacgggaucaacuggcuuacuaucggaauuagugguccugauaacggcgcuguugcagugcugaaguacaaugggauaaucaccgacacaauuaagucuuggagaaacaauaucuugaggacucaggaguccgagugugccugcgucaacggaagcuguuucaccauaaugacagauggcccaucgaauggucaggcuucuuauaaaauuuuucggaucgaaaaggggaaaguggugaaguccgucgagcucaacgcccccaauuaccacuaugaagagugcucauguuacccugacgcgggagagaucacuugcguuugccgcgauaacuggcacggcaguaauagaccaugggugagcuucaaccaaaaucuggaauaccagauuggcuauaucuguuccgggauuuuuggagacaacccgaggcccaaugaugguacgggcucuugcgggccuguaagcccaaacggagcauacggcauaaaagguuucucauuuaaguaugggaauggcguguggaucggacggacuaagaguacaaacucccgcagcggcuucgagaugauuugggaccccaacggguggaccggaacugauucuaauuuuucagucaaacaggacaucguggccaucacagacuggagugguuacagcggcuccuucguucaacauccugaacugaccgggcucgauuguauucgaccaugcuucuggguggaguuaauaagaggaaggcccaaggaaucuacgaucuggaccucgggcagcuccauuucauuuuguggugucaacagugacacagugggguggucuuggccggauggcgcugagcugccuuucacuaucgacaaauga

SEQ ID NO: 148196 - RNA, 1350 nt, Artificial Sequence
  derived and/or modified sequence opt3 from neuraminidase__InfluenzaA__BAM85824
augaaccccaaucagaagaucauuaccauaggcagcaucugcauggugauugggaucgucucccugcuccuucaaauuggaaacaugaucucuauauggaucucacacaguauucagacagguaaucagcaucaggccgagagcaucuccaacacuaauccucugacggaaaaagcuguugcaucugugaccuuggccggcaacucgucauuauguccaauuagagggugggcgguacacagcaaggacaauaguaucaggauaggauccaaaggcgauguguucgucauucgggagccguuuaucucuugcagccaucuggaaugucgcacauucuuucuaacucaaggugcucuccugaacgacaagcacuccaaugggaccgugaaagaucgaucaccccaucguacacuuaugaguugcccuguuggagaggccccaagccccuacaacucuagauucgaauccguggcauggucagccagcgcuugucacgacggcaccaguuggcugacuauuggcaucucugggccugauaauggagcagucgccguguugaaguauaacgguaucauuacagacaccauaaaguccuggaggaauaacauccuccggacgcaggagagcgagugcgcuuguguaaauggcucgugcuuuacuguuaugaccgaugggccaucuaacggacaggccuccuacaaaauuuucaagauggaaaaaggcaagguggucaaaucaguggagcuggacgcgcccaacuaucacuacgaagaguguaguugcuauccugaugcaagcgagaucacaugugugugccgcgacaauuggcaugguuccaacagaccaugggucucuuuuaaucagaaccuggaauaccaaauaggguauauuugcagcggaguuuucggcgauaauccgaggcccaacgacggcacugggucauguggaccuauguuuccaaauggugccuacggcaucaagggguucaguuuuaaguacggaaacggcguguggaucggucggaccaaauccacaaauagccgcucuggguucgagaugauuugggaucccaacggcuggaccggaacggacucaaguuuuagcguaaagcaggacaucguggcuauuacugauugguccggcuauucugggucguucguccagcacccugaacucacaggauuagacugcauacgaccauguuucuggguggagcugaucagagguaggcccaaagaaagcaccauuuggacuuccggcucaaguaucucuuuuugcgggguuaauagcgauacaguguccuggucauggccggacggagccgagcuuccuuucaccaucgauaaguga

SEQ ID NO: 148197 - RNA, 1350 nt, Artificial Sequence
  derived and/or modified sequence opt3 from neuraminidase__InfluenzaA__BAM85825
augaaccccaaucagaagaucauuaccauaggcagcaucugcauggugauugggaucgucucccugaugcuccaaauuggaaacaugaucucuauauggguuucacacaguauccagacagguaaucagaaccagguggagccuauuaucaauacuaacuuccuuacggaaaaagccguagcuagcauuacccuggcaggcaauuccucuuuguguccaaucagagggugggccauacauucgaaggacaacucaauuaggaucggaagcaaaggcgauguguuugucauucgggagccguucaucaguugcucccacuuagaaugucgcacauuuuuccugacucaaggugcgcuacucaaugacaagcauucuaacgggaccgugaaagaucgaagcccccaccguacacugauguccugcccuguuggagaggcuccaucacccuacaauaguagauuugaaagcguggccuggucugcauccgccugucaugacggcaccucauggcuuacuaucggcauuagcgggccugauaacggagcugucgcagugcugaaguauaaugguauaaucacagacaccauuaagaguuggaggaacaauaucuugcggacgcaggagucugagugcgccuguguaaacggcuccugcuucacuguuaugaccgaugggccaagcaacggacaggcuucguacaaaauauuuaagauggaaaaaggcaaggugauuaaaucugucgagcucgacgcccccaauuaucacuacgaagaguguuccugcuauccugaugcgggugagaucacaugugugugccgcgacaacuggcacgggucaaauagaccaugggugaguuucaaccagaaucuggaauaccaaaucggauauauuugcagcggcgucuuuggcgauaacccgaggcccaaugacgggacuggauccugugguccuguuucucauaacggcgcauacggggugaagggauucagcuuuaaguacggcaaugguguauggaucgggcggaccaaaucaccaaacagucgcuccggcuucgagaugauuugggaucccaauggauggagcgaaacagacucuucauuuagugugaagcaggacauagucgccaucaccgauuggagcggcuauuccgggucuuucgugcagcacccugagcugacgggacucgacugcauucgaccauguuucuggguugaauuaaucagagguaggcccaaagagucgacuguguggacaagcggcuccucaaucaguuuuugcggggucaacucugauaccgugagcugguccuggccggacggagcugagcugccuuucacuauugauaaguga

SEQ ID NO: 148198 - RNA, 1350 nt, Artificial Sequence
  derived and/or modified sequence opt3 from neuraminidase__InfluenzaA__BAM85826
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucaccccauagaacacugaugaguugcccugugggagaggccccaagccccuauaauucuagguuugaauccgucgcauggucagccagcgcuugucacgacggcaccaguuggcuuacuaucggcauuucugggccugauaacggagcaguggccguacugaaguacaaugguaucaucacagacaccauuaaguccuggcggaacaauauauugcgcacgcaggagagcgagugcgcuuguguuaacggcucgugcuucacugugaugaccgaugggccaucuaauggacaggccuccuauaaaaucuuuaagauggaaaaaggcaaggucgugaaaucaguggagcucgacgcgcccaacuaccauuaugaagaguguaguugcuacccugaugccggugagauuacaugugucugcagagacaacuggcacgggagcaauaggccauggguuuccuucaaccagaaucuggaauaucaaaucggauacauaugcucuggcguguuuggcgauaacccgcggcccaaugacgggacuggaagcugugguccuguaucacugaacggcgcauacggggugaagggauucaguuuuaaguauggcaauggugucuggauugggcgcaccaaauccacaaacagccgaucuggcuucgagaugaucugggauccaaauggauggaccggcacggacucaaguuuuagcgugaagcaggacaucguugcuauuacugauugguccggguacucuggaucguucgugcagcaccccgaacucacagguuuagacugcaucagaccuuguuucugggucgagcugauuaggggccggccaaaagaaagcaccauauggacuuccgggucaaguaucucuuuuugcggagugaacagcgauacaguauccuggucauggcccgacggcgccgagcuuccguucaccauugauaaguga

SEQ ID NO: 148199 - RNA, 1350 nt, Artificial Sequence
  derived and/or modified sequence opt3 from neuraminidase__InfluenzaA__BAM85827
augaaccccaaucagaagaucauuaccauaggcagcaucugcauggugauuggggucguuucccugaugcuccaaacaggaaacaucauuucuaucugggugucacacaguauacagaaagguaaucagcaucaggccgagagcaucuccaacacuaauccucuuacggaaaaggcuguagcaucugugacccuggccggcaacucgucauuguguccaauuagagggugggcgguccacagcaaagacaauaacaucaggauuggaaguaagggcgauguguucguuauccgggagccguuuauauccugcucucauuuagaaugucgcacauucuuucugacucaaggugcucuacucaaugacaaacacagcaacgggaccgugaaggaucgaucaccccaucguacacugauguccugcccugucggagaggccccaagucccuacaauagcagauucgaaucuguggcaugguccgccucagcuugucacgacggcaccagcuggcuuacuauuggcaucagugggccugauaacgaggcaguagccguucugaaguauaauggaauuaucacagacaccaucaaaucuuggaggaacaauauuuugcggacgcaggaguccgaaugcgcuugugugaacgguagcugcuuuacugucaugaccgauggcccaucgaacgggcaggccucuuacaagauauucaaaauggagaagggaaaaguggugaaguccgucgaacucgacgcgcccaauuaucacuacgaggaguguucaugcuauccugaugcaggcgaaaucacauguguuugccgcgacaacuggcaugguaguaauagaccaugggugagcuuuaaccagaaucuggaguaccaaauuggguauaucugcuccggaguauucggcgauaacccgaggcccaaugacggcacugggucuuguggaccuaugagcccaaacggugccuacggcgugaagggguuuucauucaaauacggaaauggcgucuggauaggucggaccaagaguacaaccucccgcagcggguuugaaaugauuugggaucccaacggcuggacgggaacugacucuucauucagugugaaacaggacaucguugcuaucacagauuggagcggcuauuccgggucuuuugugcagcacccugagcugaccggacucgacugcauucgaccauguuucugggucgaauuaaucagagguaggcccaaggagucgacuauuuggacaagcggcuccucaauaaguuucugcgggguggauucugacaccguaagcugguccuggccggauggagccgagcugccuuuuacgaucgacaaauga

SEQ ID NO: 148200 - RNA, 1350 nt, Artificial Sequence
  derived and/or modified sequence opt3 from neuraminidase__InfluenzaA__BAM85828
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucaccccauagaacacugaugaguugcccugugggagaggccccaagccccuauaauucuagguuugaauccgucgcauggucagccagcgcuugucacgacggcaccaguuggcuuacuaucggcauuucugggccugauaacggagcaguggccguacugaaguacaaugguaucaucacagacaccauuaaguccuggcggaacaauauauugcgcacgcaggagagcgagugcgcuuguguuaacggcucgugcuucacugugaugaccgaugggccaucuaauggacaggccuccuauaaaaucuuuaagauggaaaaaggcaaggucgugaaaucaguggagcucgacgcgcccaacuaccauuaugaagaguguaguugcuacccugaugccggugagauuacaugugucugcagagacaacuggcacgggagcaauaggccauggguuuccuucaaccagaaucuggaauaucaaaucggauacauaugcucuggcguguuuggcgauaacccgcggcccaaugacgggacuggaagcugugguccuguaucaccaaacggcgcauacggggugaagggauucaguuuuaaguauggcaauggugucuggauugggcgcaccaaauccacaaacagccgaucuggcuucgagaugaucugggaucccaauggauggaccggcacggacucaaguuuuagcgugaagcaggacaucguugcuauuacugauugguccggguacucuggaucguucgugcagcacccugaacugacaggucucgacugcaucagaccauguuucugggucgaguuaauuaggggccggcccaaagaaagcaccauauggacuuccgggucaaguaucucuuuuugcggagugaacagcgauacaguauccuggucauggccggacggcgccgagcugccuuucaccauugauaaguga

SEQ ID NO: 148201 - RNA, 1350 nt, Artificial Sequence
  derived and/or modified sequence opt3 from neuraminidase__InfluenzaA__BAM85829
augaaccccaaucagaagaucauuaccauaggcagcaucugcaugauuaucgggauugugucccugaugcuccaaaucggaaacauaaucucuauuugggucucacacaguauccagacagguaaucagcaucaggccgagccuauuagcgacacuaacuuccuuacggaaaaagcuguugcauccgugauccuggccggcaauucuucguugugucacauaucagggugggcgguacauagcaaggauaacaguauuagaaucggauccaaaggcgacguguuugucauuagggagccauucaucucuugcagccacuuagaaugucggaccuuuuuccugacacaaggugcucuacucaaugauaagcauuccaacgggacugugaaagaccgcucaccgcaccgaacccugaugaguugccccguuggagaggccccuagcccauacaauucucguuuugaauccguggcauggucagccagcgcuugucacgauggcacaaguuggcuuaccaucggcauuucugggcccgacaacggagcagucgccgugcugaaguauaaugguauaaucacugauacaauuaaguccuggagaaacuacaucuugaggacccaggagagcgagugcgcuuguguaaauggcucgugcuucacgguuaugacugacgggccuucuaacggacaggccuccuauaaaauauuuaagauugaaaaaggcaagguggucaaaucaguggagcucgaugcgccaaauuaccauuaugaagaguguaguugcuaccccgacgccggugagaucaccugugugugccgggauaacuggcacgggagcaaccgcccuugggucuccuucaaucagaaccuggaauaucaaaucggauacauuugcucuggcguuuuuggcgacacaccaagaccgaaugaugggacuggaagcuguggucccgugucaccuaacggcgcauacgggguaaagggauucaguuuuaaguauggcaaugguguguggaucgggaggaccaaauccacaaacagccggucuggcuucgagaugauuugggacccaaauggauggaccggcacggacucaaguuuuagcgucaagcaggaucugguggcuauaacugacugguccggguacucuggaucguucguucagcaucccgaacucacagguuuagauugcauccgcccuuguuucuggguggagcugauucgaggcagaccaaaagaaagcaccaucuggacuuccgggucaaguaucucuuuuugcggagucaacagcgacacagugggcugguccuggcccgauggugccgagcuuccguucaccauugacaaguga

SEQ ID NO: 148202 - RNA, 1413 nt, Artificial Sequence
  derived and/or modified sequence opt3 from neuraminidase__InfluenzaA__BAM85830
augaaccccaaucagaagaucauuaccauaggcagcaucugcauggccauugggacaaucucccugauucuccaaaucggaaacauaaucucuauuuggaucucacacaguauucagacugguagccagaaucauacgggcaucuguaaccagagaauaauuaccuacgagaauaacacaugggugaaucaaacuuaugucaacaucuccaauaccaacguuguggcugggaaagacacaaccucuaugauucuugcaggaaauucgucacugugcccuaucaggggcugggccaucuacagcaaggauaacaguauucggauagguuccaaaggggacguauucgugauccgcgaaccauuuauuucuuguagccacuuggagugccgaacuuucuuuuuaacacagggagcgcugcuaaaugauaagcauuccaacggcaccgucaaagaccguucaccguauagagcucucaugaguugucccaucggcgaagccccuagcccauacaauucuagguucgaguccguggcauggucagccagcgcuugccacgaugggaugggauggcugacgauagguauuaguggccccgacgauggggcaguugccgugcuuaaguauaacggaaucaucacugaaauuaucaagucuuggcggaaacagauucugcgcacccaggaguccgagugugucugcgugaacggcagcuguuuuacaauaaugacugacgguccuucgaaugggccagcuucuuacagaaucuucaagauuaaaaagggaaaaaucaccaaguccaucgaauuggaugcccccaacucacauuaugaggaaugcaguuguuacccugacacaggcaagguaaugugcguuugcagggauaauuggcacggcagcaaccggccauggguguccuuuaaucaaaaccucgacuaccagauuggguauauauguucuggagucuucggugauaauccgcgccccaaagacggcaaggggagcugcgacccugugaacguggauggagcggacggcgucaaagguuuuucauaccgauaugggaauggcguuuggaucggaagaaccaagaguaacuccagcaggaaaggcuucgagaugauuugggauccaaauggguggacggacacugauggaaacuuucuggugaagcaggacguaguggcaaugacagauuggucugguuacucaggcaguuucguccagcaccccgagcugaccgggcucgacuguaugcggccuugcuuuuggguggaauuaauccguggacaaccacgcgagaaaacuacaauuuggaccagcggcuccucuaucucguucugugguguuaauagcgauacggugaacugguccuggcccgacggggccgaacugccguucaccauagauaaguga

SEQ ID NO: 148203 - RNA, 1413 nt, Artificial Sequence
  derived and/or modified sequence opt3 from neuraminidase__InfluenzaA__BAM85831
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggauuggauggcuuacgaucgguauauccggcccagacaacggggccguggcuguccugaaauauaacggaauuaucacugaaaccaucaagagcuggaaaaagcagauuuugagaacacaggagucggagugcguguguguaaauggcucuugcuuuacuaucaugaccgauggucccuccaacggggccgcgucauacaaaauuuucaagauagaaaagggaaaaguuacaaagaguaucgagcucaaugcaccuaacuuucacuaugaagaguguagcugcuacccagacaccggcacggugaugugugucugcagggauaauuggcacggcuccaaccggcccugggugucuuucaaucagaaccuggacuaccaaauuggguauaucugcagcggaguguuuggugauaauccucgcccaagagacggcgaggggucauguaacccggucacugccgauggagcuaauggcguuaaagguuucaguuacaaguaugggaacggcguguggaucggaaggacaaaauccaaucggcugcgcaagggcuuugaaaugauuugggaccccaacggguggaccgacacugauagcgacuucucuguaaaacaggauguggucgccauaacagacuggucaggauacagugguagcuuugugcagcauccugagcucaccggcuuagggugcauccgaccauguuucuggguugaacuggugagaggacuucccagggagaauacgaccauuuggacauccgguucuucgaucagcuucugcggcgucaacuccgauacugcaaacuggucauggccugacggggcugaauugccauuuaccauugauaaguga

SEQ ID NO: 148204 - RNA, 1413 nt, Artificial Sequence; identical to SEQ ID NO: 143524
  derived and/or modified sequence opt3 from neuraminidase__InfluenzaA__BAM85832

SEQ ID NO: 148205 - RNA, 1410 nt, Artificial Sequence
  derived and/or modified sequence opt3 from neuraminidase__InfluenzaA__BAM85833
augaaccccaaucagaagaucauuaccauaggcagcacaugcauggugaucgggauuaucucccugauucuccaaaucggaaacauaaucucuauuugggucucacacaguauccagacugguaaucagaaccagccugagacguguaaucaaagcguuauuaccuacgaaaacaaaacaugggugaaucagacuuauguaaacaucuccaauaccaaccuugugauagagagagacgucauuucuguggcccuguugggcaauucgucauuaugcccaaucagcgggugggcuauuuacaguaaggauaacggaaucaggaucggcuccaaaggugacguuuucgugauucgggaaccguuuauaucuuguagccaucuggagugccgcacauucuuucuaacccagggggcacuccugaaugauaagcacuccaacggaacugucaaagaccgaucacccuaucguacacuuaugaguuguccugugggcgaagccccaagccccuacaauucuagauucgaguccguagcguggucagcuagcgccugccaugauggcaucaguuggcugaccguugggauuucuggaccugacaacggugcaguggccgucuugaaguauaacggcaucauaacggauacugugaaguccuggaggaauaacauucuccggacccaggagagcgaaugugcuugcaucaaugggucguguuuuacaaucaugacugacggaccaucuaacggccaagcauccuacaaaauuuucaagaucgagaaagguaagguggucaaaucaguugaacugaaugcccccaacuaucacuacgaggagugcaguuguuacccugaugcuagcgaaauuaugugcgugugccgcgacaauuggcauggguccaacagaccauggguaucuuuuaauaggaaccuggaguaucagauaggauacaucuguagcggcguguucggcgauaauccgcggcccaacgacgggaccggaucaugcgguccugucaguuccaauggcgccuauggggugaagggauuuagcuucaaguacggcaaagguguuuggauugggcgcacaaagucuaccucaagucgaagcggcuuugaaaugaucugggauccaaacggauggacggagacugacuccucuuucucggugaaacaggacaucgucgcgauuacagauuggagcggcuauuccgggucauuugugcagcaccccgaacucaccggauuagacuguauaagaccuugcuucuggguagagcugaucaggggucggccaaaggagaauacuauuuggacaaguggcucuagcaucuccuucugugggguuaacucagauaccgugggauggagcuggcccgacggcgcagaacuuccguuuacgauugauaaauga

SEQ ID NO: 148206 - RNA, 1410 nt, Artificial Sequence
  derived and/or modified sequence opt3 from neuraminidase__InfluenzaA__BAM85834
augaaccccaaucagaagaucauuaccauaggcagcgugucccugacagucgccacuguuugcuuccucaugcaaaucgcuauucuuacgaccacagugacucugcacuuuaaacagaacgaguguucuaucccugcaaauaaccagguaaugccaugcgaaccgauugugaucgagagaaauauaaccgaaaucgucuacuugaacaauacaaccauugagaaggaaaucuguuuaaaagccgcggaguauaggaacuggucaaagccccagugccaaauuacuggguucgcuccuuuuaguaaagacaauagcauccggcuguccgccggaggugauauaugggugacacgcgagccauacguuucuugugaccccucgaagugcuaucaguucgcacuaggccaggggaccacgcucgaaaacaagcauucaaauggaacuauucacgaucgaaucccucaucguacccugcuuaugaacgagcugggcgugccauuucacuuggguacaaaacaggucuguauugccuggagcaguuccucuugccaugacgggaaggcuuggcuccacguguguguaacuggagaugacagaaaugcaaccgccagcuucaucuacgauggcaugcugguugacuccaucggcucauggagucaaaacauucugaggacacaggaaagcgagugcguguguauaaaugggaccugcgcugucgugaugacggauggaucugccuccggucgggcggacacucgcauccucuuuauuagagagggcaaaaucgugcacauaucacccuuaagcgggagugcacagcauauugaagagugcucuuguuauccuagguacccaaucauccggugcgucugucgcgauaacuggaagggauccaaccgaccgguuauugacaucaauauggccgauuauagcauugacucgucuuacgugugcuccggccugguaggugacacacccagaaacgaugacucaaguagcuccucuaauuguagggauccuaacaaugaacgggggaacccaggagugaaaggcugggcuuucgacaauggcaacgaugucuggauggggcguaccauaagcaaggacucacgcaguggauacgagacuuuuagagugaucgguggcugggccacagcaaauuccaagagccagaccaacaggcaaguuauuguggauaauaacaauuggucuggguauucaggaaucuucagugucgaaagcaaauccugcaucaaccgguguuuuuacguggagcuuauucgaggccgcccccaggagacgagaguaugguggaccucuaauucgauaguuguguucugcgguacaagcgggacuuauggcaccggauccuggccugacggcgcuaacaucaacuuuaugccaauuuga

SEQ ID NO: 148207 - RNA, 1410 nt, Artificial Sequence
  derived and/or modified sequence opt3 from neuraminidase__InfluenzaA__BAM85835
augaaccccaaucagaagaucauuaccauaggcagcgugucccugacaaucgccacugucugcuuccucaugcaaauugcuauccuugcaacgaccguuacacugcacuuuaaacagaacgaguguucuauuccugccaauaaccaggugguaccaugcgaaccgaucauaaucgagagaaauauuacugaaaucguguacuugaacaauaccacaauugagaaggaaaucuguucaaaagcggucgacuauaggaacuggaguaagccccagugccaaauaaccggguucgcuccuuuuagcaaagauaauuccauucgguuaucugccggaggugacaucugggugacucgcgagccauacguuucgugugauacaucaaagugcuaucaguucgcacugggccaggggaccacgcuagacaacaagcauagcaauggaacuauucacgaucgaaucccccaucguacccuccugaugaacgagcuuggcgugccuuuucaccuggguacaaaacaggucuguaucgccuggaguuccucuagcugccaugacgggaaggcuugguugcacguguguguaacuggagaugacagaaaugcaaccgccuccuucauuuacaacggcaugcucguugauucaauaggcaguuggagccaaaauauccugaggacacaggaaucugagugcguguguauuaacggguccugcaccgucgugaugacggacggaucagcuagcgguaaagccgauacucggauccuguuugugaaggaaggcaaaauaauucacaucaguccacucucuggguccgcgcagcauaucgaggagugcagcuguuauccccgcuacccuaacgucagaugcguuuguagggacaauuggcggggaucgaaccgcccagugauugauaucaauauggcagacuauucuauugacuccucauacguaugcaguggcuuagugggugauacaccgcgaaacgacgauaauagcuccucuagcaacuguagagaccccaauaacgaaagggggaauccuggagucaagggcugggccuucgauucaggcgacgauguguggauggggcggaccauaagucgugacucccgcagcggauacgagacuuuuaagguuaucgguggcugggcuacagccaacucuaaaucacagaccaguagacaagugauugucgauaauaacaauuggagcggguauuccggaguguucucuguagaacacaagucgugcaucaacagguguuuuuacguugagcugauccggggccgaccacaggaaacgcgcgugugguggaccagcaauuccauugucguguucugcgguacaucagggacuuauggcaccggaaguuggcccgacggcgcaaacauaaacuuuaugccuaucuga

SEQ ID NO: 148208 - RNA, 1410 nt, Artificial Sequence
  derived and/or modified sequence opt3 from neuraminidase__InfluenzaA__BAM85836
augaaccccaaucagaagaucauuaccauaggcagcgugucccugacaaucgccacuauuugcuuccucaugcaaaucgcuauucuugcaacgaccgucacacugcacuuuaaacagaacggguguucuaucccuucaaauaaccagguugugccaugcgagccgauaaucguagaaagaaauauuacugagaucguguacuugaacaauaccacaauugaaaaggaguuaugucccaaaguccuggaauauagggacuggaguaagccucagugccaaaucaccggauucgccccauuuagcaaagauaacuccauacggcuaucugcggguggcgacauuugggugacucgcgagcccuacguuucguguucaccugauaagugcuaucaguucgcucucgggcagggaacaacccuggacaaucgacauagcaacggcacgauccacgaucguauuccacauagaacucuucugaugaaugaguugggugugcccuuucaccucgggaccaagcaggucuguaucgccuggaguuccucuagcugccaugacggaagggcauggcugcacguguguguaacaggcgaugaccggaacgccacugcuuccuucaucuacgauggcaugcugguugacucaauugggaguuggagccaaaauauacuccgcacccaggaaucugagugcguguguaucaacggaacaugcaccgucgugaugacggaugguuccgcaucaggcagagccgacacuaggauuuuauuugugaaagaagggaagaucguccacauaagcccucugaguggaucugcucagcauauugaggagugcuccuguuauccacgguacccggauguucgcugcgugugucgagacaauuggaaaggcagcaacagacccaucaucgacauuaacauggccgauuauucgaucgguucuuccuacguaugcucagggcuugugggagacacaccuaggaaugaugacaguagcuccaacucuaauugucgggauccaaacaaugaacguggcaaccccggcgucaaggggugggcguucgacuacggaaaugauguguggaugggucgcaccauuagcaaagacucaagaaguggcuaugagacuuuuaggguuauagggggauggacaaccgcaaacuccaagagccaggugaaucggcaagucaucguggauaacucuaauuggucaggcuacagugguauuuucagcguagaagggaaguccugcaucaaccgauguuuuuauguugaguugauccgcggcagaccucaggaaacgagggugugguggaccucuaauucgauugucguguucugcggaacaagcggcacuuacgggaccggauccuggccagacggugccaacauaaauuuuaugcccaucuga

SEQ ID NO: 148209 - RNA, 1410 nt, Artificial Sequence
  derived and/or modified sequence opt3 from neuraminidase__InfluenzaA__BAO79717
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagauuaauaggcaagugauaguagaccguggggaucgguccggauacagcggcaucuucucuguugaagguaaaaacuguauuaaucgcugcuuuuauguggagcugaucagagggaggaaggaagagaccgaaguccuauggacaucaaacaguaucguggucuucuguggcacuagcggaaccuacggcacaggguccuggccugacggagccgaucucaaucugaugccaauuuga

SEQ ID NO: 148210 - RNA, 1413 nt, Artificial Sequence; identical to SEQ ID NO: 137075
  derived and/or modified sequence opt3 from neuraminidase__InfluenzaA__CAA33354

SEQ ID NO: 148211 - RNA, 1404 nt, Artificial Sequence
  derived and/or modified sequence opt3 from Neuraminidase__InfluenzaA__CAB95858
augaaccccaaucagaagaucauugcccugggcagcguguccauaaccaucgcuacaauuugccuccuuaugcaaaucgcaauucuggccacuacgaugaccuugcacuucaacgaguguacaaauccuucuaacaaucaggcgaugccaugcgaaccgaucauaaucgagagaaacauuacugaaaucguccauuuaaauaacaccacaauugagaaagaaucaugucccaagguugcugaguacaaaaauuggaguaagccucagugccagaucaccggguuugccccauucagcaaagacaacuccauaaggcugucugcaggaggugauauuugggugacucgggagcccuauguaucguguggccuagggaauugcuaccaauuugcccucggacagggcacaacccugaacaauaagcacucaaacgguacgauccaugaccgcagcccucaccgaacucuucugaugaaugaauugggggugccauuccaucucggaaccaagcaggucuguauugcuuggaguuccucuagcugccacgauggcaaagcauggcugcacguguguguuacaggcgacgaucguaacgccacugcuuccaucaucuaugacgggaugcugaccgauucaauuggaaguuggagcaagaacauacucagaacacaggagucugaaugcguguguaucaaugguaccugcacggucgugaugacugacggcuccgccucagggagggcggauacaaaaauuuuauuuauccgggagggaaagauaguacauauuagcccccugaguggcucugcacaacacguugaggaaugcuccuguuacccucgcuauccagaggugagaugcgucuguagggacaacuggaaagguagcaaucggccggugcuuuacaucaacguggccgauuauucggucgacucuuccuacguuugcucaggguuggugggagauacuccccgcaaugacgacaguagcuccucuagcaacugucgagauccuaauaacgaaagaggcggcccagggguaaagggaugggcuuucgacaaugguaacgauguguggaugggcaggaccaucaagaaagacucacggaguggguacgagacauuucgugucgugggaggcuggaccacggccaauuccaagagccagauuaaccgccagguuaucguggauucugacaauuggucagguuauagugggauuuucagcgucgaaggcaaaaccugcauaaacagauguuuuuacguggagcugaucaggggacggccccaggagacacgaguaugguggacuuccaauucuauuaucguuuucugcggcaccucggggacauauggaacugguagcuggccugauggcgcaaacaucaacuuuauguccauuuga

SEQ ID NO: 148212 - RNA, 1404 nt, Artificial Sequence
  derived and/or modified sequence opt3 from neuraminidase__InfluenzaA__CAB95859
augaaccccaaucagaagaucauugcccugggcagcguguccauaaccaucgcuacaauuugccuccuuaugcaaaucgcaauucuggccacuacgaugaccuugcacuucaacgaguguacaaauccuucuaacaaucaggcggucccaugcgaaccgaucauaaucgagagaaacauuacugaaaucguucauuuaaauaacaccacaauugagaaagaaucaugucccaagguggcugaguacaaaaauuggaguaagccucagugccagaucaccggguuugccccauucagcaaagacaacuccauaaggcugucugcaggaggugauauuuggguaacucgggagcccuaugugucguguggccuagggaagugcuaccaauuugcccucggacagggcacaacccugaauaacaagcacucaaaugguacgauccaugaccgcagcccucaccgaacucuucugaugaacgaauugggggucccauuccaucucggaaccaaacagguguguauugcuuggaguuccucuagcugccacgauggcaaggcauggcugcacguuugugugacaggcgacgaucguaaugccacugcuuccaucaucuaugacgggaugcugaccgauucaauuggaaguuggagcaaaaacauacucagaacacaggagucugaaugcgucuguaucaacgguaccugcacggugguaaugacugacggcuccgccucagggagggcggauacaaagauuuuauuuauccgggagggaaaaauaguucauauuggcccccugagcgguagugcacaacacguggaggaaugcucuuguuacccucgcuauccagaggucagaugcguguguagggacaauuggaagggguccaaccggccggugcuuuacaucaaugucgccgauuauagcguugacucgucuuacgugugcuccggauugguaggcgauacuccccgcaacgacgacucaaguagcuccucuaauugucgagauccuaacaaugaaagaggcgggccaggagugaaggguugggcuuucgacaacggcaaugaugucuggauggggaggaccaucaaaaaggacagccggucaggauacgagacauuucgugugguuggcgguuggaccacggccaacaguaaaucccagauuaaucgccaggugaucgucgauagcgacaacuggucuggguauucaggcauuuucaguguggaaggaaagaccugcauaaauagauguuuuuacguagagcugaucaggggccggccccaggagacacgaguuugguggacuagcaacuccauuaucguguucugcgggaccucuggaacauaugguacuggcucguggccugauggggcaaauaucaacuuuaugagcauuuga

SEQ ID NO: 148213 - RNA, 1410 nt, Artificial Sequence; identical to SEQ ID NO: 136589
  derived and/or modified sequence opt3 from Neuraminidase__InfluenzaA__CAC19707

SEQ ID NO: 148214 - RNA, 1410 nt, Artificial Sequence
  derived and/or modified sequence opt3 from neuraminidase__InfluenzaA__CAD29959
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuugaacccaaauaacgaggaaggaggccacggcguuaaagggugggccuucgacgauggaaaugacguguggaugggucgcacgaucucugagaagcugcgaagcggcuacgagaccuuuaaagucaucgaaggguggucaaagcccaacaguaaacuacagauuaauagacaggugaucguagauaggggaaaccgguccggcuauagcgguauuuucucuguugaggggaagucaugcauaaaucguuguuuuuacguggaacucauccgcggcagaaagcaggagacagaaguccuguggaccaguaacagcauuguggucuucugcggaacuuccggcacauaugggacuggaucuuggccugacggugcggauaucaaucuuaugccaaucuga

SEQ ID NO: 148215 - RNA, 1410 nt, Artificial Sequence
  derived and/or modified sequence opt3 from neuraminidase__InfluenzaA__CAD29960
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacguucgaacacccuaucguacucuucugaugaaugaauugggcgugccuuuucaucucgguaccaagcaggucuguaucgccuggucgucaagcaguugccacgaugggaaagcauggcugcauguguguguaacaggagacgaugagaacgccaccgcuuccuucauuuacaauggcagacugguugacucuaucggcagcugguccaagaaaauccucaggacgcaggaaucagagugcguguguauuaacgggacuugcacagucgugaugaccgauggaagugcaagcgguaaggccgacacuaaaauauuauuuaucgaggaaggcaagauugugcacacaucuccacuguccgggucagcucaacacgucgaggaaugcagcuguuauccgcgguaccccggaguucgcugcguguguagagauaacuggaagggcaguaauaggccuaucguagacauaaacgugaaagauuacucuauugucuccagcuaugugugcucgggucuuguuggggacaccccacggaagaaugacucuuccucaaguagccauuguuugaaccccaauaacgaggaaggaggccacggcgugaaagggugggccuucgaugacggaaaugaugucuggaugggucgcacgaucuccgagaagcugcgaucuggcuacgagaccuuuaaagugaucgaaggguggagcaagccuaacucaaaacuacagauuaauagacagguaaucguugacaggggaaaccggaguggcuauuccgguauuuucagcguggaggggaagucuugcauaaaucguuguuuuuacgucgaacucauccgcggcagaaagcaggagacagaagugcuguggacuucaaacaguauugucguguucugcggaaccagcggcacauaugggacuggauccuggccagauggugcggacaucaaucuuaugcccaucuga

SEQ ID NO: 148216 - RNA, 1410 nt, Artificial Sequence
  derived and/or modified sequence opt3 from neuraminidase__InfluenzaA__CAD29961
augaaccccaaucagaagaucauuaccauaggcagcgugucccugacaaucucuacuauuugcuucuuuaugcaaaucgccauucucgucacgaccguuacacuucacuucaaacaguacgaguguaacucaccuccaaauaaccaggugaugcugugcgaaccgacuaucauagagagaaauaccacagaaaucguauauuugaccaacacuacaauugagaaggaaaucugucccaaauuagcugaguacaggaauuggaguaagccucagugcaacauuaccggguuugcaccauucagcaaagacaauuccauccggcugucugccggaggugauauaugggugacgcgcgagcccuaugucucgugugacccugauaagugcuaccaauuugcgcuaggccaggggacuacccucaacaauggacauucaaacgacacagugcacgaucgaacuccauaucguacccugcuuaugaaugaacugggcguucccuuccauuuggguacaaaacagguguguauugcuuggagcaguuccucuugccacgacgggaaggccuggcuccaugucugugugaccggagaugacgagaacgcaacggccagcuuuaucuacaauggcagacugguagauuccauuggcucauggaguaagaaaauccugaggacucaggaaagcgagugcguuuguaucaacgggacaugcaccguggucaugacugacggaucugcuuccgguaaggcagauacaaaaauucucuucauagaggaaggcaagaucgugcacaccucaacguuaagcgggagugcccaacacguggaggaaugcucuuguuauccucgguacccaggaguccgcugcguuuguagagacaacuggaagggcuccaauaggccgauuguggauaucaacauaaaagacuacagcauuguaucgucuuaugugugcuccggucuggucggggacacaccccggaagaaugauucaaguagcuccucucauugucuugacccuaacaaugaggaaggaggccacggcgugaaagggugggcuuuugaugacggaaacgauguuuggaugggucgcaccaucagcgagaaguugcgaucaggcuacgagacuuucaaagugaucgaaggguggaguaagccaaauuccaaacugcagauuaacagacaggucaucguggacaggggaaaucggagcggcuauucugguauauuuucaguagaggggaagaguugcauuaaccguuguuucuacguugaacuaauccgcggcagaaagcaggagaccgaagugcucuggacaagcaauuccauugucguguuuugcggaacuucuggcaccuaugggacaggaucgggucccgauggcgccgacaucaaccugaugccuaucuga

SEQ ID NO: 148217 - RNA, 1410 nt, Artificial Sequence; identical to SEQ ID NO: 143561
  derived and/or modified sequence opt3 from neuraminidase__InfluenzaA__CAD29962

SEQ ID NO: 148218 - RNA, 1410 nt, Artificial Sequence; identical to SEQ ID NO: 136300
  derived and/or modified sequence opt3 from neuraminidase__InfluenzaA__CAD29963

SEQ ID NO: 148219 - RNA, 1410 nt, Artificial Sequence; identical to SEQ ID NO: 136300
  derived and/or modified sequence opt3 from neuraminidase__InfluenzaA__CAD29964

SEQ ID NO: 148220 - RNA, 1410 nt, Artificial Sequence; identical to SEQ ID NO: 136300
  derived and/or modified sequence opt3 from neuraminidase__InfluenzaA__CAD29965

SEQ ID NO: 148221 - RNA, 1410 nt, Artificial Sequence; identical to SEQ ID NO: 136300
  derived and/or modified sequence opt3 from neuraminidase__InfluenzaA__CAD29966

SEQ ID NO: 148222 - RNA, 1410 nt, Artificial Sequence; identical to SEQ ID NO: 136056
  derived and/or modified sequence opt3 from neuraminidase__InfluenzaA__CAD29967

SEQ ID NO: 148223 - RNA, 1410 nt, Artificial Sequence; identical to SEQ ID NO: 136056
  derived and/or modified sequence opt3 from neuraminidase__InfluenzaA__CAD29968

SEQ ID NO: 148224 - RNA, 1410 nt, Artificial Sequence; identical to SEQ ID NO: 136589
  derived and/or modified sequence opt3 from neuraminidase__InfluenzaA__CAD29969

SEQ ID NO: 148225 - RNA, 1410 nt, Artificial Sequence
  derived and/or modified sequence opt3 from neuraminidase__InfluenzaA__CAD29970
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacccggggauaaggugcgucugucgggacaauuggaagggaucuaaccgccccauuguugauaucaacgugaaagacuacuccaucguaagcucguaugugugcucuggccuugucggugacacaccucgaaagaaugauuccucaaguagcucccacuguuugaacccaaauaacgaggaagggggacauggcgugaaaggcugggccuucgacgaugggaaugacguuuggaugggaagaaccauuucugagaagcugaggagcgguuacgagacguuuaaagugaucgaaggcuggucaaagcccaacaguaaacuacagauuaaucggcaggucauaguggaucgugggaaccgcuccggauauagcggcaucuucucuguagaggguaagucaugcauuaauagauguuuuuacguugaacucaucagggggcggaagcaggagaccgaagugugguggacaaguaacagcaucgucguguucugcggcacuuccggaaccuauggcacagggucuuggccugacggagcggauauuaaucugaugccaauauga

SEQ ID NO: 148226 - RNA, 1410 nt, Artificial Sequence; identical to SEQ ID NO: 138571
  derived and/or modified sequence opt3 from neuraminidase__InfluenzaA__CAD29971

SEQ ID NO: 148227 - RNA, 1410 nt, Artificial Sequence
  derived and/or modified sequence opt3 from neuraminidase__InfluenzaA__CAD29972
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaacaucacaggguucgcaccauuuaguaaagacaauagcauacggcuauccgccggaggugauauuugggucacccgcgagcccuaugugucuugugacccugauaagugcuaccaauucgcgcucggccaggggacgacucugaacaauggacauucgaacgacaccguucacgaucgaacaccauaucguacucuucugaugaaugaauugggcgugcccuuucaucucgguaccaagcaggucuguaucgcuuggucaagcaguuccugccacgacgggaaagccuggcugcauguguguguaacaggagaugacaagaacgcaaccgccucuuucauuuacaauggcagacugguugauagcaucggcuccuggaguaaaaagauccucaggacgcaggagucagaaugcguguguauuaacgggacuugcgcugucgugaugacagacggaagcgcaucugguaaagccgauaccaagauauuauuuaucgaggagggcaagauugggcacacuucccugcuuucaggaagcgcucaacacguggaagagugcaguuguuauccucgguacccaggcguccgcugcguuuguagagacaacuggaaagguucuaauaggccgaucguggauauaaacguaaaggacuacuccauugugagcucguaugucugcucuggguuggugggagacacaccccggaaaaaugauuccucaaguagcucccauugucuggacccuaacaaugaagagggcggccacgggguuaagggaugggccuucgaugacgguaacgauguguggaugggccgcaccaucucugaaaaacuacgaagcggguacgagacguuuaaggucaucgagggauggucaaaaccaaauaguaagcuccagauuaacagacaggugaucguagacaggggcaaucgguccgguuauagcgggauuuucucuguugaaggcaagucaugcauaaaccguuguuuuuacguggagcugauccgcggaagaaaucaggaaaccgagauucuuuggacaaguaacagcaucgucguguucugcggcacuuccgggaccuauggaacagguucuuggcccgauggcgcggacaucaaucugaugccuauuuga

SEQ ID NO: 148228 - RNA, 1410 nt, Artificial Sequence
  derived and/or modified sequence opt3 from neuraminidase__InfluenzaA__CAD29973
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaagauccuccggacgcaggaaucagagugcguuuguauuaacgggacuugcacaguggucaugaccgauggaagcgcaucuggucgcgccgacacuaaaauauuauuuaucgaggaaggcaagauugugcacaucuccccucugucagggagcgcucaacauguggaggaaugcaguuguuauccaagauacucuggagucaggugcguuugucgggauaauuggaagggcuccaaccgcccgauaguggacauuaacguaaaagauuacagcaucgugucgucuuaugucugcuccggucuugugggggacacaccccgaaagaaugacucaaguagcuccucucacuguuugaacccuaauaacgaggaaggaggccauggcguuaaagggugggccuucgaugacggaaaugauguguggauggguagaaccaucagcgagaagcugaggucaggcuacgagacguuuaaagucauugggggauggaguaagccaaacuccaaacuacagaucaaucgucaggugauuguagaccggggcaaccgcagcgguuauucugggauauucucaguugaaggcaagaguugcaucaauagauguuuuuacguggagcucauuaggggacggaagcaggaaaccgaggucugguggacaagcaacuccaucguggucuucugcggcacuucugggaccuauggaacagguucguggcccgauggcgcggacaucaaucugaugccuauuuga

SEQ ID NO: 148229 - RNA, 1410 nt, Artificial Sequence; identical to SEQ ID NO: 144600
  derived and/or modified sequence opt3 from neuraminidase__InfluenzaA__CAD29974

SEQ ID NO: 148230 - RNA, 1410 nt, Artificial Sequence
  derived and/or modified sequence opt3 from neuraminidase__InfluenzaA__CAD29984
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcauuaugucucuugugaccgagauaagugcuaccaauucgcucucggccaggggacgacucugaacaauggacacucgaacgacaccgugcaugaucguacacccuauagaacucuucugaugaaugaauugggcguuccuuuucaccucgguaccaaacagguguguaucgccuggucaagcaguuccugccaucacgggaaggcauggcugcacgucugugugacaggagacgaugagaacgccaccgcuucuuucauuuacaauggcaggcugguagacagcaucggcuccuggucaaagaaaauccuccggacgcaggaaagugagugcguuuguauuaacgggacuugcacaguggucaugaccgauggaagcgcaucugguaaggccgacacuaaaauauuauuuaucaaggagggcaagauugugcauacauccucacugagcgggagugcucaacacguggaagagugcucuuguuauccacgcuaccccggagucagaugcguuuguagggauaacuggaaaggcuccaaucggccuaucguggacauaaacguaaaggauuacagcauugugucgucuuaugucugcuccggucuugugggggacaccccacgcaaaaaugacucaaguagcuccucucauuguuuggauccgaacaaugaagagggaggccacggcguuaaggggugggccuucgacgauggaaacgacguguggaugggucgaacgaucagcgaaaaacugagaucaggcuacgagaccuuuaaggucaucgagggguggaguaaagcaaauuccaagcuacagauuaacaggcaagugaucguagaucggggaaaucguagcggcuauucugguauuuucucaguugaaaguaagagcugcauaaaccgcuguuuuuacguggagcucaucagagggaggaaacaggaaacagagguccuguggacuuccaauucuauuguggucuucugcggcaccucgggaacauauggcacugggagcuggcccgacggagcggauaucaaccuuaugccuaucuga

SEQ ID NO: 148231 - RNA, 1410 nt, Artificial Sequence
  derived and/or modified sequence opt3 from neuraminidase__InfluenzaA__CAD29985
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacgccccggaagaaugauuccuucucaaguagccauuguuuggacccuaacaaugaggaaggaggccacggcguuaaagggugggccuuugaugacggaaacgauguguggaugggucgcaccaucuccgagaagcugcgaucuggcuacgagaccuucaaagucauugaaggguggagcaagccaaauucaaaacuacagaucaacagacaggugauuguagagaggggaaaucggaguggcuauuccgguauauuuagcguugaagggaagucuugcaucaaccguuguuucuacguggagcucauucgcggcagaaaggaagagacagaggucugguggacuucaaauaguaucguggucuuuugcggaaccagcaggacauauggcacuggguccuggcccgacggagcggauaucaaccugaugccuauuuga

SEQ ID NO: 148232 - RNA, 1410 nt, Artificial Sequence
  derived and/or modified sequence opt3 from neuraminidase__InfluenzaA__CAD29988
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugagaaagccgauacuaagauauuauuuaucgaagaggguaaaauugugcacaucuccacacugucaggcagcgcucaacacguggaagagugcaguuguuauccucgcuacccaggggucagaugcguuuguagggacaacuggaagggaucuaaucggccgauaguggauauuaacguaaaggacuacuccaucgugagcucguaugucugcucuggccuugugggugacacccccaggaaaaaugauuccuucucaaguagccauuguuuggacccuaacaaugaagaagggggacacggcguuaagggcugggccuuugaugacgggaacgauguguggaugggacgaacgaucuccgagaaacugagaucugguuacgagaccuucaaggucauugagggcuggagcaaaccaaauucaaagcuacagaucaaccgccaggugauuguagaacgggggaaucguaguggauauuccggcauauuuagcguugaggguaaaucuugcaucaaccgcuguuucuacguggaacucauuagagggaggaaggaggagacagaagucugguggacuucaaauaguaucguggucuuuugcggcaccagcggaacauauggcacuggguccuggcccgacggagcggauaucaaccugaugccuauuuga

SEQ ID NO: 148233 - RNA, 1410 nt, Artificial Sequence
  derived and/or modified sequence opt3 from neuraminidase__InfluenzaA__CAD29990
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacggccgaacaccauaucguacucuucugaugaaugaauuggguguucccuuucaucucgggaccaaacagguguguaucgccuggucaagcaguuccugccacgauggaaaggcauggcugcaugucugugugacaggcgacgaugagaacgccaccgcuucuuucauuuacaauggcagacugguagacagcaucggguccuggucaaagaaaauccucaggacgcaggaaagugagugcguuuguauuaacggaacuugcacaguggucaugaccgaugguagcgcaucuggcaaggccgacacuaaaauauuauuuaucgaggaagggaagauugugcacacaucccugcuuucaggaagcgcucaacacguggaggaaugcaguuguuauccucgguacccaggcguccgcugcguuuguagagauaacuggaaggguucuaauaggccgaucguggacauaaacguaaaagauuacuccauugugagcucguaugucugcucuggguuggugggagacacgccccggaagaaugacaacuccucaaguagccauugucuggauccuaauaacgaggaaggcggccacgggguuaaaggaugggccuucgacgaugguaaugacguguggaugggccgcaccaucuccgagaagcuacgaucuggguacgagaccuuuaaagucaucgaaggauggagcaagccaaacucaaaacuccagauuaauagacaggugaucguagauaggggcaaccggagugguuauuccgggauuuucagcguugagggcaagucuugcauaaaucguuguuuuuacguggaacugauccgcggaagaaagcaggagacagaaguccuuuggacuucaaacaguauuguggucuucugcggcaccagcgggacauauggaacugguuccuggcccgacggcgcggauaucaaucugaugccuaucuga

SEQ ID NO: 148234 - RNA, 1410 nt, Artificial Sequence; identical to SEQ ID NO: 136077
  derived and/or modified sequence opt3 from neuraminidase__InfluenzaA__CAD29991

SEQ ID NO: 148235 - RNA, 1410 nt, Artificial Sequence
  derived and/or modified sequence opt3 from neuraminidase__InfluenzaA__CAD29992
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagaccgguccauugugagcucguacgucugcucugguuuggugggggacacccccaggaagaaugauuccucaaguagcucccauugucuggacccuaacaaugaggaaggaggccacggcguuaaagggugggccuucgaugacggaaacgauguguggaugggucgaacgaucucugagaagcuaagaagcggcuaugagaccuuuaaagucaucgaaggguggucaaagccaaauaguaaacuccagauuaaccgccaggugaucguagaccggggaaaucguuccggcuacagcgguauuuucucuguugaggggaagucaugcauaaaccgcuguuuuuauguggaacugaucagaggcaggaagcaggagacagaaguccuuuggaccaguaauagcauuguggucuucugcggaacuuccggcacauacgggacuggaucuuggcccgauggugcggacaucaaccugaugccuaucuga

SEQ ID NO: 148236 - RNA, 1410 nt, Artificial Sequence
  derived and/or modified sequence opt3 from neuraminidase__InfluenzaA__CAD29993
augaaccccaaucagaagaucauuaccauaggcagcgugucccugacaaucgccacuacgugcuuccucaugcaaauugcuauccuugucaccacaguuacucugcacuuuaaacaguacgaguguaacucuccuccaaauaaccaggugauguugugcgaaccgaccauuaucgagagaaauauaacagaaaucguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguauugccuggucaagcaguuccugccacgacgggaaggcauggcugcaugucugugugaccggagaugacgagaacgccacggcuucuuucaucuacaauggcagacugguagauagcauuggcuccuggucaaagaaaauccucaggacucaggaaagugagugcguuuguaucaacgggacaugcaccguggucaugacugacggaagcgcaucugguaaggccgauacaaaaauuuuauuuauagaggaaggcaagaucgugcacaccuccccucugucagggagcgcucaacacguggaggaaugcaguuguuauccacgguacccgggaguccgcugcguuuguagagacaacuggaagggcucuaauaggcccauuguggauaucaacguaaaagacuacuccauagugagcucguaugucugcucuggucuugugggggacacgccucggaagaaugauuccucaaguagcucccauuguuuggacccaaacaaugaggaaggaggccacggcguuaaagggugggccuucgaugacggaaacgauguguggaugggucgcaccauuucugagaagcugcgaagcggcuacgagacauuuaaagucaucgaaggguggucaaagcccaauaguaaacuacagaucaacagacaggugauuguagacaggggaaaucgguccggcuauagcgguaucuucucuguugaggggaagucaugcauuaaccguuguuuuuacguggaacucauacgcggcagaaagcaggagacugaaguccuguggaccaguaauagcaucguggucuucugcggaacauccggcacuuaugggaccggaucuuggccugauggugcggacauuaaccuuaugccaaucuga

SEQ ID NO: 148237 - RNA, 1410 nt, Artificial Sequence; identical to SEQ ID NO: 137765
  derived and/or modified sequence opt3 from neuraminidase__InfluenzaA__CAD29994

SEQ ID NO: 148238 - RNA, 1413 nt, Artificial Sequence; identical to SEQ ID NO: 138469
  derived and/or modified sequence opt3 from neuraminidase__InfluenzaA__CAD57252

SEQ ID NO: 148239 - RNA, 1413 nt, Artificial Sequence
  derived and/or modified sequence opt3 from neuraminidase__InfluenzaA__CAD57253
augaaccccaaucagaagaucauuaccauaggcagcaucagaauugccaucgggauuaucucccugaugcuccaaauaggaaacaucauuucuaucugggcuucacacaguauucagacagguagccagaaucauacuggcgugugcaaccagaggaucauaacguacgaaaauuccaccugggucaaccacacauauguuaauauuaacaauacuaacgugaucgcagggaaagacaagaccucuguaacacuugccggaaauucgucacuguguagcauuaguggcugggcgaucuacaccaaagauaacuccauccggauugguucuaagggggacguguucgucauacgcgagccuuuuaucagcugcucccauuuggagugucgaacuuucuuuuuaacacaaggagcucugcuaaaugauaaacacucaaacggcaccgugaaggaccguaguccauauagagcccucaugagcugcccgcugggcgaagcacccucuccuuacaauuccaaguucgagucaguugccuggagcgcuagugcaugucaugaugggaugggauggcuuacgauugguaucucuggcccagacaacggggccguggcuguccugaaauauaacggaauaauuacugaaaccaucaaguccuggaaaaagcagaucuugaggacacaggagagcgagugcguguguguaaauggcucgugcuuuacuauuaugaccgauggucccucuaacggggccgcguccuacaaaaucuucaagauugaaaagggaaaaauaacaaagucaaucgagcucaaugcaccuaacuuucacuaugaagaguguaguugcuacccagacaccggcacgguuaugugugugugccgggauaauuggcacggcagcaaccgccccugggucuccuucaaucagaaccuggacuaccaaauuggguauaucugcucuggaguguuuggugauaauccuagaccaaaagacggcgaggggagcuguaacccggugacugucgauggagccaauggcguuaaggguuucucauacaaauaugggaacggcguguggaucggaaggacaaagaguaaucggcugcgcaaaggcuuugaaaugauuugggaccccaacggguggaccgacacugauuccgacuucagcguaaagcaggauguggucgcuauaacagacuggucuggauacucagguaguuuugugcagcauccugagcucaccggcuuagauugcauccgaccauguuucuggguugaacuggugagagggcuucccaaggagaauacgaccauuuggacaagcggauccucuaucucguucugcggcgucaacagcgacacugccaacugguccuggccugauggugcagaauugccauuuaccauugacaaauga

SEQ ID NO: 148240 - RNA, 1413 nt, Artificial Sequence; identical to SEQ ID NO: 136412
  derived and/or modified sequence opt3 from neuraminidase__InfluenzaA__CAD57255

SEQ ID NO: 148241 - RNA, 1413 nt, Artificial Sequence
  derived and/or modified sequence opt3 from neuraminidase__InfluenzaA__CAD57256
augaaccccaaucagaagaucauuaccauaggcagcaucuccguggccauugggaucauuucucugaugcuccaaaucggaaacauaaucucaauuugggcuagucacagcauccagacagguucccagaaucauacuggcauuugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccaacggggccgcgucauaccggauuuucaaaaucgaaaagggacgcgugacaaagaguauugagcucgacgcaccuaauuaucacuacgaagaguguagcugcuacccagauaccggcacggucaugugugugugcagagacaacuggcacggcuccaauaggcccugggugucuuuuaaccagaaucuggauuaucagauaggguacaucugcagcggagucuucggugacaacccucggccaaaagauggcgaggggucauguaauccgguuacuguggacggagccgacggcguaaaggguuuuaguuauaaauacgggaacggcguguggauuggacgcacaaaguccaaucgacugagaaaaggcuucgaaaugaucugggaucccaacggguggaccgacacugauagcgacuuuucugucaagcaagaugugguugcuaucacagacuggucaggauauagugguagcuucgugcagcauccugagcucaccggcuuagauugcauuaggccauguuuuugggucgaacuggugcgggggcguccccgcgagaauacgaccauauggacauccggaucuucgaucagcuucugcggcguaaacuccgacacugccaauuggucauggccugauggugcagaacuuccauucaccauugacaaauga

SEQ ID NO: 148242 - RNA, 1413 nt, Artificial Sequence
  derived and/or modified sequence opt3 from neuraminidase__InfluenzaA__CAD57257
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacagccacuaugaagaguguuccugcuacccagacaccggcacggugaugugugucugccgggauaauuggcacggcucuaaccgccccugggugagcuuuaaucagaaccuggacuaccagaucggguauauuugcucaggaguguucggugauaauccuagaccaaaagacggcgaggggaguuguaacccggucacuguugauggagccgacggcgugaaggguuuuuccuacagguaugggaauggcguauggaucggacggacaaaaagcaaccgccugcgaaagggcuucgaaaugaucugggaccccaauggguggaccgauacugacucugauuuuucaaugaaacaagacguggucgcuaugacagauuggaguggauacagcgguuccuucgugcagcauccugagcucaccggcuuagacugcauuagaccauguuuuuggguugaacuggugagggggcggccccgugagaacacgaccauauggacaucuggaucgagcaucuccuucugcggcgucaauucagauacugccaacuggaguuggccugacggugcagaacuuccauucaccauugauaaguga

SEQ ID NO: 148243 - RNA, 1413 nt, Artificial Sequence
  derived and/or modified sequence opt3 from neuraminidase__InfluenzaA__CAD57258
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagagaauaauuacguaugaaaauucuaccugggucaaccaaacauacguuaauaucaacaauacuaacgugguagcagggaaagacaagaccucgauggugcuugccggaaauucaagccuguguccuauuaggggcugggcgaucuauacaaaagauaacaguauccggauugguuccaagggggacauauucgucauccgcgagccauuuauuucuugcagccauuuggagugucgaaccuucuuuuuaacucagggagcucugcuaaaugauaaacacuccaacggcacagugaaggaccguucaccguacagagcccucaugaguugcccccugggcgaagcaccuagcccauauaauucuagguucgaguccguugccuggucagcuagcgcaugucaugaugggcuuggauggcugaccaucgguauaaguggccccgacaacggggccguggcugucuugaaguacaacggaauuaucacggaaacuaucaaaucuuggaagaaacagauucuccggacccaggaguccgagugcguguguguaaauggcagcugcuuuacaaucaugacugaugguccuucgaaccgcgccgcgucuuauagaauuuucaagauagaaaaagggaggguuaccaaguccaucgagcuggacgcaccaaauuaccacuacgaagaguguucaugcuaucccgauacaggaaccgugaugugugucugccgggacaacuggcauggcaguaaucgcccuugggugagcuuuaaccaaaaucuggauuaccagauuggcuauaucugcuccgggguguucggagacaacccacgaccgaaggauggugagggcucuuguaaucccgucacgguugacggggccgacggagugaaaggcuuuagcuacagauaugguaacgggguauggaucggcaggacuaagucaaaucggcuccguaaaggauucgaaaugauuugggauccuaacggcuggacagacaccgauagugacuuuuccaugaagcaggauguggucgcuaugacugacuggagcggguacucuggaucauucgugcagcacccagaguuaacaggucuggauugcaugcgccccuguuuuuggguugaacuugugagaggcuugccuagggagaauaccacgauauggaccagugggagcuccaucucuuucugcggagucaacucggaaacagccaauuggagcuggccagacggcgcagagcugcccuucacuauugauaaauga

SEQ ID NO: 148244 - RNA, 1413 nt, Artificial Sequence
  derived and/or modified sequence opt3 from neuraminidase__InfluenzaA__CAD57259
augaaccccaaucagaagaucauuaccauaggcagcaucuccauugccaucgggauuaucucucugauacuccaaaucggaaacauuaucucaauuugggcuagucacagcauccagacagagucccagaaucauacugguauaugcaaccagagaauuaucacguacgaaaauucuaccugggugaaccaaacauaugucaauauuaacaauacuaacguugcagccggcaaagacaagaccucgaugacacuugcggggaauagcagccuguguccuaucaggggaugggcuaucuacaccaaagauaacaguauucggauaggcuccaagggugacaucuucgugauucgcgagccauuuaucucuugcagccacuuggaaugucgaacuuucuuuuuaacacagggggcccugcuaaaugauaaacauuccaacggaaccguaaaggaccguucaccguauagagcacucaugaguugcccccugggcgaggccccuagcccauacaauucuagguucgaauccguggcuuggucagcaagcgccugucacgauggccuuggguggcugacgauaggaauuaguggucccgacaacggcgcugucgccguguugaaguauaacgggaucaucacugagaccauuaaaucuuggaagaaacggauccuccgcacacaggaguccgaaugcguuuguaugaauggaagcugcuuuacuauuaugaccgauggcccuucgaacggugcggcaucuuacagaauauucaagaucgagaaagggagggugacaaaguccauugaacuggacgccccaaauuaucauuacgaggaguguucaugcuaccccgaaaccggaacggucaugugugugugccgggauaacuggcacggcaguaaucgcccuuggguaucauuuaaccagaaucuggacuaucaaaucggcuacaucugcuccgggguuuucggagauaacccacgaccgaaggacggugagggcucuuguaaucccgugacugucgauggggcugacggagugaaaggcuuuagcuauagauacgguaacgggguguggauuggcaggacaaagucaaaucggcuccguaaaggauucgaaaugauaugggacccuaacggcuggaccgauacugacagugauuuuuccaugaagcaggacaucgucgccaugacagauuggagcggguauucuggaucauucguucagcacccagaguuaaccggucuggacugcaugcgccccuguuuuuggguggaacuuguaagaggcuugccuagggagaauacgaccauuuggacaagugggagcuccaucucuuucugcggagugaacucggauacugcaaauuggagcuggccagacggcgcugagcugcccuucaccauugauaaauga

SEQ ID NO: 148245 - RNA, 1413 nt, Artificial Sequence
  derived and/or modified sequence opt3 from neuraminidase__InfluenzaA__CAD57264
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagagaauaauuacguaugaaaauucuaccugggucaaccaaacauacguuaauaucaacaauacuaacgugguagcagggaaagacaagaccucgaugacacuugccggaaauucaagccuguguccuauuaggggcugggcgaucuauaccaaagauaacaguauccggauugguuccaagggggacguguucgucauacgcgagccauuuaucucuugcagccauuuggagugucgaacuuucuuuuuaacacagggagcucugcuaaaugauaaacacuccaacggcaccgugaaggaccguucaccguacagagcccucaugaguugcccccugggcgaagcaccuagcccauauaauucuagguucgaguccguugccuggucagcuagcgcaugucaugaugggcuuggauggcugacgauugguaucaguggccccgacaacggggccguggcugucuugaaguacaacggaauaauuacugaaaccaucaaaucuuggaagaaacagauccuccggacacaggaguccgagugcguguguguaaauggcagcugcuuuacuauuaugaccgaugguccuucgaacggggccgcgucuuaucgcaucuucaagauugaaaaaggaagaguuacaaaguccauagagcuggacgcaccaaauuaccacuacgaagaguguucaugcuaucccgauaccggcacggugaugugugucugcagggacaacuggcauggcaguaaucggccuugggugagcuuuaaccaaaaucuggauuaccagaucggguauauuugcuccggaguguucggugacaacccacgcccgaaggauggcgaggggucuuguaaucccgucacuguugacggagccaacggcgugaaagguuuuagcuaccgauaugggaauggcguauggaucggaagaacaaagucaaacaggcuccggaaaggcuucgaaaugaucugggacccuaauggguggaccgauacugacagugauuuuuccaugaagcaggacguggucgcuaugacagauuggagcggauacucugguucauucgugcagcacccagaguuaaccggccuggacugcaugcgucccuguuuuuggguugaacuugugcgcggguugccuagagagaacacgaccauuuggacaaguggaagcuccauaucuuucugcggcgucaauucggaaacugccaacuggagcuggccagauggugcagagcugcccuucaccaucgacaaauga

SEQ ID NO: 148246 - RNA, 1350 nt, Artificial Sequence
  derived and/or modified sequence opt3 from neuraminidase__InfluenzaA__CBW54819
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaucaguuggcuuaccauuggcaucucugggccugauaacggagcaguggccguacugaaguacaaugguaucauuacugacacaauaaaguccuggaggaacaauaucuugcggacccaggagagcgagugugcuugcguuaacggcucguguuucacggugaugacugaugggccaucuuccggacaggccucauauaaaauuuuuaagauggaaaaaggcaaggucgugaaaaguguggagcucgacgcgcccaauuaccauuaugaagagugcagcuguuacccugaugcaggagagauaaccugcgucugccgcgacaacuggcacggguccaacagaccauggguuucuuucaaucagaaccuggaauauaggaucggauacauuuguagcggcguguuuggcgauaauccgcggcccaacgacgggacaggaucaugcgguccuguaaguccaaauggcgccuacggggugaagggauucuccuuuaaguauggcgauggugucuggaucgggcgcacuaaaagcaccaacucucgaucaggcuucgagauggugugggaccccaauggauggacaggcaccgacaguagcuuuuccguuaagcaagauaucguggcuauuacggacuggucuggguacucggguagcuucguccagcacccugaacugacuggucucgauuguaucagaccaugcuucuggguggaguuaauuaggggccggcccaaagaauccacaauauggaccucagggaguucuaucagcuuuuguggaguaaacuccgacacuguuucauggagcuggccggauggcgccgagcugccuuucacaauugacaaguga

SEQ ID NO: 148247 - RNA, 1350 nt, Artificial Sequence
  derived and/or modified sequence opt3 from neuraminidase__InfluenzaA__CBW54821
augaaccccaaucagaagaucauuaccauaggcagcaucugcauugugaucgggauugucucccugaugcuccaaaucggaaacaugauaucuaucuggguuucacacaguauucagacagguaaucagugucaggccgagccuaucagcaacacuaaauuccuuacggaaaaggcuguggcauccguaacccuggccggcaauucuucguugugcccaauuucagggugggcgguguacagcaaagacaacaguaucagaauaggauccaggggcgaugucuuugugauucgggagccguucaucucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcauuaguuggcuuaccaucggcaucucugggccugauaacggagcaguggccguacugaaguacaaugguauuauaacugacacaaucaaguccuggaggaacaauauuuugcggacccaggagagcgagugugcuugcaucaacggcucguguuucacgguuaugacugaugggccaucuuccggacaggccucauauaaaauauuuaagauggaaaaaggcaagguggucaaaaguguggagcucgacgcgcccaauuaccauuaugaagagugcagcuguuacccugaugcaggagagauuaccugcgugugccgcgacaacuggcacggguccaacagaccaugggucucuuucaaucagaaccuggaauaucaaaucggauacaucuguagcggcguuuuuggcgauaauccgaggcccaacgacgggacaggaucaugcgguccugugaguccaaauggcgccuacgggguaaagggauucuccuuuaaguauggcaacgguguguggauugggcggacuaaaagcaccaauucucgcucaggcuucgagaugaucugggaucccaacggauggacaggcaccgacaguagcuuuuccgucaagcaggacauuguggcuauaacggauuggucuggguacucggguagcuucguucagcacccugaacugacuggucucgacuguauccgaccaugcuucuggguggaguuaauuagaggccagcccaaagaauccacaaucuggaccucagggaguucuaucagcuuuuguggagucaauuccgauacugugucauggagcuggccggacggcgccgagcugccuuucacaauugauaaguga

SEQ ID NO: 148248 - RNA, 1410 nt, Artificial Sequence
  derived and/or modified sequence opt3 from neuraminidase__InfluenzaA__CCG47912
augaaccccaaucagaagaucauuaccauaggcagcgugucccugacaaucgccacuaugugccucuucaugcaaauugcuauccuuauuacgaccgucacacugcacuuuaaacaguacgagugugacucuccugcaaacaaucagguuaugccaugcgaaccgaucauaaucgagaagaacauuacuaaaaucguguauuugaccaauacaaccauugaaaaggagguaugucccaaauuaggggaauacagaaacuggucaaagccucagugcaggaucacuggauucgccccauuuaguaaggauaauagcauacggcuguccgcggguggcgcuauuugggugacacgcgagcccuaugucucuugugacccuaacaaaugcuaccaauucgcccuagggcagggaaccacgcucgauaaucgacauucgaacgacacuauccacgaucguaccccauauagaacacugcuuaugaaugagcugggcgugcccuuucauuuggguacuaggcagguuuguauugcauggucaagcaguuccugccacgacgggaaggccuggcuccaugugugugucaccggacacgauaaaaacgcuacagcaucuuucaucuacgacggcaagcugguggauagcaucuccucauggagucagaauauucugcggacccaagaaagcgagugcguauguauaaacggcaucugcacgguugugaugacugacgggucugccuccggaaaagcugauacaaagauucucuuuaucgaagaggguaaggucauacacauuucaccuuuacugggcagcgcccagcauguggaggaaugcaguuguuauccacgcuacccggacgugagaugcaucuguagggauaauuggaaagggucuaaccggcccaucgucgacauucgcaugaaggacuacuccaucggaagcucguauaugugcucuggccuuguuggugauaccccucgaaacaaugacggguccucaaacaguaauuguagaaacccaaauaacgagaggggaaaucacggcgugaaaggcugggcguucgaugacgggaacgauauuuggaugggacggacuauaagcaaggacucccguuuggguuacgaaacauuuaaaguagugggcggguggucucagcccaauagcaaguuccagaucaaccgccaagucauuguggauucagacaauagaaguggauauuccggcaucuuuagcguugaggguaaaucuugcaucaacagguguuucuacguggaacugauucgggggcgacgccaggagaccagagucugguggacgucaaauaguauagugguauuuugcggcaccagcggaacauauggcuccgggucuuggccugauggagcagacaucaacuucaugccaauuuga

SEQ ID NO: 148249 - RNA, 1353 nt, Artificial Sequence
  derived and/or modified sequence opt3 from neuraminidase_subtype_1__InfluenzaA__AAF74321
augaaccccaaucagaagaucauuaccauaggcagcaucugcaugguggucgggauuaucucccugaugcuccaaauuggaaacaucauaucuguuugggugucacacacaauccagacuuggcauccuaaucagccagagccguguaaccagaguauuaauuucuacacggaacaagccgcugcaagcguaacccuugccgguaacuccucucugugccccaucucgggcugggcgauuuauucaaaagacaauagcaucagaauagggaguaagggagauguguuugucauuagggagccuuucaucuccuguucucacuuggaaugccggacauuuuucuuaacucagggcgcucugcuaaacgacaaacauagcaaugguaccgugaaggaucgcuccccauaccgaacacucaugucaugucccguuggggaggccccuaguccauauaacagccguuuugaaucuguggcaugguccgccucagcuugccacgacggaauuagcuggcugaccaucggcaucaguggccccgauaauggggcagucgccgugcuuaaauacaacggaauuauaacugacacaaucaagucuuggagaaauaacauucugaggacccaggaguccgagugugcuugcguaaaugguagcuguuucacgguuaugacugauggcccuucgaacgaacaggccucuuauaagaucuuuaaaauagagaaggggcggguggucaaauccguggaauugaacgcgccaaauuaccauuaucaagagugcucauguuacccggacgcaggagagauuaccugcgugugccgcgauaacuggcacggcaguaauagacccugggucagcuucaaccagaaucucgaauaccagaucgguuauaucuguuccgggguuuuuggagacucuccuaggccaaacgauggcacaggcagcugcgggcccgugucacugaauggagccuacgguguaaagggcuucaguuuuaaauaugggaacggaguguggauuggccggacuaaguccaccagcucucgcucagguuucgagaugaucugggacccuaauggguggacagaaaccgauaguagcuuuucccugaagcaggacauuauagcuaucacggacuggucuggcuacucgggcagcuucauucaacacccagagcucacuggauuaaacuguaugcgacccugcuucugggucgaacugaucagagggaggccgaaagagaagacaaucuggaccuccggaucaaguauuucuuuuuguggugugaauagcgauacuguuggcugguccuggccugacggggccgagcuucccuucacaauagauaaauga

SEQ ID NO: 148250 - RNA, 1353 nt, Artificial Sequence
  derived and/or modified sequence opt3 from neuraminidase_subtype_1__InfluenzaA__AAF74322
augaaccccaaucagaagaucauuaccauaggcagcaucugcaugguggucgggauuaucucccugaugcuccaaauuggaaacacaaucucuguuugggugucacacauaaucaaaacuuggcauccuaaucagccagagccguguaaccagaguauuaauuucuacacggaacaggccgcugcaagcguaacccuugccgguaacuccucucugugccccaucucgggcugggcgauuuauucaaaggacaauagcaucagaauagggaguaaaggagauguguuugucauuagggagccuuucaucuccuguucucacuuggaaugccggacauuuuucuuaacucaaggcgcucugcuaaacgacaagcauagcaaugguaccgugaaagaucgcuccccauaccgaacacucaugucaugucccguuggggaggccccuaguccauauaacagccguuuugaaucuguggcaugguccgccucagcuugccacgacggaauuagcuggcugaccaucggcaucaguggccccgauaauggggcagucgccgugcuuaaguacaacggaauuauaacugacacaaucaagucuuggagaaauaacacccugaggacgcaggaguccgagugugcuugcguaaaugguagcuguuucacuguuaugaccgauggcccuucgaacgaacaggccucuuauaaaauuuuuaagaucgagaaagggcggguggucaaguccguggaauugaacgcgccaaauuaccauuaugaggagugcucauguuacccggacgcaggagaaauaacaugcgugugccgcgauaacuggcacggcaguaauagacccugggucagcuucaaccagaaucucgaguaccaaauugguuauaucuguuccgggguuuuuggagacucuccuaggccaaacgauggcacuggcagcugcgggcccgugucacugaauggagccuacgguguaaaaggcuucaguuuuaaguaugggaacggaguguggaucggccggaccaaguccacaagcucucgcucagguuucgaaaugauuugggacccuaauggguggaccgagacggauaguagcuuuucccugaaacaggacaucauugcuauaacugacuggucuggcuacucgggcagcuucauccagcacccagaacucacaggauuaaacuguaugcgacccugcuucugggucgagcugauuagagggaggccgaaggagaaaaccaucuggacuuccggaucaaguaucucuuuuuguggugugaauagcgauacaguuggcugguccuggccugacggggccgaacuucccuucaccauugauaaguga

SEQ ID NO: 148251 - RNA, 1353 nt, Artificial Sequence
  derived and/or modified sequence opt3 from neuraminidase_subtype_1__InfluenzaA__AAF74323
augaaccccaaucagaagaucauuaccauaggcagcaucugcaugguggucgggauuaucucccugaugcuccaaauuggaaacaucauaucuguuuggaucucacacauuauccagacauggcauccuaaucagccagagccguguaaccagaguauuaauuucuacacugaacaagccgcugcaagcgugacgcuugccgguaacuccucucugugccccaucucgggcugggcgauauauucaaaagacaauagcauuagaaucgggaguaagggagauguauuugugauuagggagccuuucaucuccuguucucacuuggaaugccggaccuuuuucuuaacacagggcgcucugcuaaacgacaaacauagcaaugguacugucaaggaucgcuccccauaccgaacccucaugucaugucccgugggggaggccccuaguccauauaacagccguuuugaaucuguugcaugguccgccucagcuugccacgacggaaucagcuggcugacaauuggcauaaguggccccgauaaugaggcaguggccguccuuaaauacaacgggaucauuaccgacacuaucagaucuuggaggaauaacauacugcggacacaggaguccgaaugugcuugcgugaauggaagcuguuucaccguaaugacggaugguccuucgaacgagcaggccucuuauaagauuuuuaagaucgaaaaaggccgcguugugaaguccgucgaguugaacgcgccaaauuaccauuaugaggaaugcucauguuacccggacgcaggggagaucacuugcgugugcagagauaacuggcacggaaguaauaggcccugggugagcuucaaccaaaaucucgaauaccagauuggcuauaucuguuccggugucuuuggggacucuccucggccaaacgauggaaccggcagcugcggccccguuucacugaauggggccuacggagugaaagguuucaguuuuaaguauggcaacgggguauggauuggacgcacaaaauccacuagcucucgaucaggcuucgagaugauaugggacccuaaugguuggaccgaaacagauaguagcuuuucccugaagcaggacaucauugcugugaccgacuggucuggguacucgggcagcuucauccagcacccagagcucacgggauuaaacuguaugagacccugcuucugggucgagcugaucaggggccggccgaaggagaaaacuauuuggacauccgggucaaguauaucuuuuuguggagugaauagcgauaccguugguugguccuggccugacggcgccgaacuucccuucacuaucgauaaguga

SEQ ID NO: 148252 - RNA, 1353 nt, Artificial Sequence
  derived and/or modified sequence opt3 from neuraminidase_subtype_1__InfluenzaA__AAF74324
augaaccccaaucagaagaucauuaccauaggcagcaucugcaugguggucgggauuaucucccugaugcuccaaauuggaaacaucauaucuguuugggugucacacaucauucagacauggcauccuaaucagccagagccguguaaccagaguaucaauuucuacacugaacaagccgcugcaagcguaacgcuugccgguaacuccucucugugccccauuucgggcugggcgaucuauucaaaagacaauagcauaagaauugggaguaagggagauguguuugucaucagggagccuuucauuuccuguucucacuuggaaugccggaccuuuuucuuaacacagggcgcucugcuaaacgacaaacauagcaaugguacugugaaggaucgcuccccauaccgaacccucaugucaugucccguuggggaggccccuaguccauauaacagccguuuugaaucuguggcaugguccgccucagcuugccacgacggaaucagcuggcugacaaucggcauuaguggccccgauaauggggcagucgccgugcuuaaauacaacggaauaaucaccgacacuauuaagucuuggagaaauaacauccugaggacacaggaguccgagugugcuugcguaaaugguagcuguuucaccguuaugacggauggcccuucgaacgaacaggccucuuauaagauauuuaaaauugagaaggggcggguggucaaauccguggaauugaacgcgccaaauuaccauuaugaggagugcucauguuacccggacgcaggagaaaucacuugcgugugccgcgauaacuggcacggcaguaauagacccugggucagcuucaaccaaaaucucgaguaccagaucgguuauauuuguuccgggguuuuuggagacucuccuaggccaaacgauggcaccggcagcugcgggcccgugucacugaauggagccuacgguguaaagggcuucaguuuuaaauaugggaacggaguguggaucggccggacaaaguccacuagcucucgcucagguuucgaaaugauuugggacccuaauggguggaccgagacagauaguagcuuuucccugaagcaggacauaaucgcuauuaccgacuggucuggcuacucgggcagcuucauccagcacccagaacucacgggauuaaacuguaugcgacccugcuucugggucgagcugaucagagggaggccgaaagagaagacuauuuggacauccggaucaagugugucuuuuugugguguuaauagcgauaccaugggcugguccuggccugacggggccgaacuucccuucacuauagauaaauga

SEQ ID NO: 148253 - RNA, 1353 nt, Artificial Sequence
  derived and/or modified sequence opt3 from neuraminidase_subtype_1__InfluenzaA__AAF74325
augaaccccaaucagaagaucauuaccauaggcagcaucugcaugguggucgggauuaucucccugaugcuccaaauuggaaacacaaucucuguuugggugucacacauaaucaaaacuuggcauccuaaucagccagagccguguaaccagaguauuaauuucuacacggaacaggccgcugcaagcguaacccuugccgguaacuccucucugugccccaucucgggcugggcgauuuauucaaaggacaauagcaucagaauagggaguaaaggagauguguuugucauuagggagccuuucaucuccuguucucacuuggaaugccggacauuuuucuuaacucaaggcgcucugcuaaacgacaagcauagcaaugguaccgugaaagaucgcuccccauaccgaacacucaugucaugucccguuggggaggccccuaguccauauaacagccguuuugaaucuguggcaugguccgccucagcuugccacgacggaauuagcuggcugaccaucggcaucaguggccccgauaauggggcagucgccgugcuuaaguacaacggaauuauaacugacacaaucaagucuuggagaaauaacacccugaggacgcaggaguccgagugugcuugcguaaaugguagcuguuucacuguuaugaccgauggcccuucgaacgaacaggccucuuauaaaauuuuuaagaucgagaaagggcggguggucaaguccguggaauugaacgcgccaaauuaccauuaugaggagugcucauguuacccggacgcaggagaaauaacaugcgugugccgcgauaacuggcacggcaguaauagacccugggucagcuucaaccagaaucucgaguaccaaauugguuauaucuguuccgggguuuuuggagacucuccuaggccaaacgauggcacuggcagcugcgggcccgugucacugaauggagccuacgguguaaaaggcuucaguuuuaaguaugggaacggaguguggaucggccggaccaaguccacaagcucucgcucagguuucgaaaugauuugggacccuaauggguggaccgagacggauaguagcuuuucccugaaacaggacaucauugcuauaacugacuggucuggcuacucgggcagcuucauccagcacccagaacucacaggauuaaacuguaugcgacccugcuucugggucgagcugauuagagggaggccgaaggagaaaaccaucuggacuuccggaucaaguaucucuuuuuguggugugaauagcgauacaguuggcugguccuggccugacggggccgaacuucccuauaccauugauaaguga

SEQ ID NO: 148254 - RNA, 1410 nt, Artificial Sequence; identical to SEQ ID NO: 138744
  derived and/or modified sequence opt3 from neuraminidase__InfluenzaA__EPI239900

SEQ ID NO: 148255 - RNA, 1410 nt, Artificial Sequence; identical to SEQ ID NO: 139093
  derived and/or modified sequence opt3 from neuraminidase__InfluenzaA__EPI221062

SEQ ID NO: 148256 - RNA, 1410 nt, Artificial Sequence; identical to SEQ ID NO: 138744
  derived and/or modified sequence opt3 from neuraminidase__InfluenzaA__EPI534079

SEQ ID NO: 148257 - RNA, 1410 nt, Artificial Sequence; identical to SEQ ID NO: 138744
  derived and/or modified sequence opt3 from neuraminidase__InfluenzaA__AGM53851

SEQ ID NO: 148258 - RNA, 1410 nt, Artificial Sequence
  derived and/or modified sequence opt3 from neuraminidase__InfluenzaA__EPI731464
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggggaucgucauugugcccugugagcggcugggcgauauacaguaaggacaauuccguuagaauugguucuaaaggggauguguuugucaucagggagccauucauuagcuguuccccguuagaaugccggaccuuuuuccugacacagggagcucuacucaacgacaagcauucaaauggcaccaucaaagaucgcagucccuaucgaacucugaugagcuguccuaucggcgaggugccaucucccuacaacucccguuuugaaucaguagccuggagcgcaagugccugccacgacgggauuaacuggcuuacaauaggaaucucugguccugauaauggcgcuguugcagugcugaaguauaacgggauuaucaccgacacgauaaaguccuggagaaauaacauuuugaggacucaagagagcgagugugccugcgucaauggaucguguuucaccgugaugacagauggcccaucuaacggucaggcuuccuacaaaaucuuucggaucgaaaaggggaaaauugugaagucagucgagaugaaugcccccaacuaucauuacgaagagugcaguuguuacccugacagcuccgagaucacuugcguuugccgcgauaauuggcacggaucuaacagaccaugggugagcuucaaucagaaccucgaauaucagauuggcuacauauguucaggcaucuuuggggacaauccgaggcccaacgauaaaaccggaaguugcgguccuguauccagcaauggcgcgaacggggugaagggauucucuuuuaaguauggcaacggugucuggauugggcggacaaaaucaaucaguagccgcaauggcuucgagaugaucugggacccaaacggauggaccggcacggauaauaacuuuuccauuaagcaagacauaguggggaucaaugaauggucuggauacucggguagcuucguucagcaucccgagcugacuggccuggacuguauucgaccuugcuucuggguggaacucaucagagggaggccaaaagagaacacaauuuggaccuccggaucaaguaucucuuuuuguggcgucaauagcgauacuguggguugguccuggcccgacggggcagaguuaccguucacaauagauaaguga

SEQ ID NO: 148259 - RNA, 1410 nt, Artificial Sequence; identical to SEQ ID NO: 138744
  derived and/or modified sequence opt3 from neuraminidase__InfluenzaA__EPI696973

SEQ ID NO: 148260 - RNA, 1410 nt, Artificial Sequence
  derived and/or modified sequence opt3 from neuraminidase__InfluenzaA__EPI662593
augaaccccaaucagaagaucauuaccauaggcagcaucugcaugacaauugggauggccaaccugauccuccaaauuggaaauaucauauccaucugggugucucacucaauucagaucgguaaccagagucagauugagacuuguaaucaaagcgucaucacguacgaaaacaauaccuggguuaaccagacauaugugaauauauccaacacuaauuucgcugcaggccagucuguagugucggucaaacuugccgggaacucaagccugugcccugugaguggaugggcgauuuacuccaaggacaauucuguuagaaucggcagcaaaggugauguguuugucauuagggagccauucaucuccuguucaccguuggaaugccggaccuuuuucuuaacacagggggcucugcuaaacgacaagcauaguaauggaaccaucaaagaucgcagccccuaucgaacucucaugucuuguccuauuggcgaggugccaucccccuacaacucacguuuugaaagcguagccuggagugcaucugccugccacgacggcauaaacuggcugacaaucgggauuuccggaccugauagcggugcuguugcagugcuuaaguauaauggcaucauaaccgacacgauuaagucguggagaaacaauauccugaggacucaagagucugagugugccugcgucaacggguccuguuucaccaucaugacagauggaccaucagacggccaggcuaguuacaaaauuuuucggaucgaaaaggguaaaauuauaaagagcguggagaugaaagcccccaauuaucauuacgaagagugcuccuguuacccugauucuagcgagaucacuugcgugugccgcgacaacuggcacgggucaaauagaccaugggucaguuucaaccagaauuuggaauaucagaugggauacauuuguuccggcguuuuuggcgauaacccgaggcccaaugacaagaccgggagcugcggaccugugucuucaaacggugcgaauggcguaaagggguucaguuuuaaauauggaaacggcguguggaucggucggacaaagagcaucuccucucgcaaaggguucgagaugauuugggauccaaauggcuggaccggaacggacaacaaguuuucgauaaaacaagacaucgucggcauuaacgaauggagcggguacuccggaucauucgugcagcaucccgagcucacuggucuggauuguauccgaccuugcuucuggguugaacugauuagaggcaggccagaggagaauacaaucuggaccagugggucuagcauauccuuuuguggagugaacucagacacugucggcuggagcuggcccgauggugcagaacucccguucacaaucgacaaguga

SEQ ID NO: 148261 - RNA, 1410 nt, Artificial Sequence; identical to SEQ ID NO: 148260
  derived and/or modified sequence opt3 from neuraminidase__InfluenzaA__EPI830229

SEQ ID NO: 148262 - RNA, 1410 nt, Artificial Sequence; identical to SEQ ID NO: 145853
  derived and/or modified sequence opt3 from neuraminidase__InfluenzaA__AGU92879

SEQ ID NO: 148263 - RNA, 1410 nt, Artificial Sequence; identical to SEQ ID NO: 145852
  derived and/or modified sequence opt3 from neuraminidase__InfluenzaA__AGU92857

SEQ ID NO: 148264 - RNA, 1410 nt, Artificial Sequence; identical to SEQ ID NO: 145851
  derived and/or modified sequence opt3 from neuraminidase__InfluenzaA__AGU92846

SEQ ID NO: 148265 - RNA, 1410 nt, Artificial Sequence; identical to SEQ ID NO: 145862
  derived and/or modified sequence opt3 from neuraminidase__InfluenzaA__AGU92835

SEQ ID NO: 148266 - RNA, 1410 nt, Artificial Sequence; identical to SEQ ID NO: 145838
  derived and/or modified sequence opt3 from neuraminidase__InfluenzaA__AGU92703

SEQ ID NO: 148267 - RNA, 1410 nt, Artificial Sequence
  derived and/or modified sequence opt3 from neuraminidase__InfluenzaA__EPI643117
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaauguauaugcaucaacggcacuuguacaguggucaugaccgacgggucugcuuccggaaaggcagauacuaaaauucuguuuaucgaggaggguaagauagugcauacaucaacccucagcggcagugcccaacacguggaagagugcucuugcuauccacgcuacccgggggucagauguguuugcagggacaacuggaagggauccaaucggcccauuguggauaucaacaucaaagaccacagcauuguaucgucuuacguguguuccggcuuagucggugacacgccucgcaagaaugauucaaguagcuccucucauugccuggacccaaacaaugaagaagggggacacggcgugaaaggcugggcuuucgaugacgggaacgauguuuggaugggacgaaccaucaaugagacaagcagacuugguuaugagacuuuuaaggugauugagggcuggucaaaccccaaaaguaaguugcagaccaauaggcaggucauaguggaccguggggaucgguccggauacagcggcaucuucucuguagaagguaaaucauguauuaaccgcugcuuuuauguugagcugaucagagggaggaaggaagagacagaagugcuauggaccaguaauagcaucgucguguucuguggcacuuccggaacauacggcaccgggucuuggccugacggagccgaucucaaccugaugccaauuuga

SEQ ID NO: 148268 - RNA, 1410 nt, Artificial Sequence
  derived and/or modified sequence opt3 from neuraminidase__InfluenzaA__EPI675797
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaaggugcgagaccguacccccuauagaacacuccugaugaaugaacuuggcguuccuuuucaccuggguacuaaacaggugugcauugcuuggagcaguuccucuugucaugaugggaaggccugguugcacgucugcaucaccggagacgauaaaaacgcaacagccagcuucaucuacaauggcaggcucguggacuccguaguuucauggaguaaggauauucugcggacccaggagagcgaauguauaugcaucaacggcacguguacuguggucaugacagacgggucugcuuccggaaaagcagauaccaagauucuguuuaucgaggaggguaagauagugcauacuucaacacucagcggcagugcccaacacguggaagagugcucuugcuauccacgcuacccgggggucagauguguuugcagggacaacuggaaaggauccaaucggcccauuguggauaucaacaucaaggaccacagcauuguaucgucuuacguguguuccggcuuagucggugacaccccucgcaaaaaugauucaaguagcuccucucauugccuggacccaaacaaugaagaagggggacacggcgugaagggcugggcuuucgaugacgggaacgauguuuggaugggacgaacgaucaaugagaccagcagacuugguuaugagacauuuaaagugauugagggcuggucaaaccccaagaguaaauugcagacuaauaggcaggucauaguggaccguggggaucgguccggauacagcggcaucuucucuguagaagguaagucauguauuaaccgcugcuuuuauguugagcugaucagagggaggaaggaagagaccgaagugcuauggacaaguaauagcaucgucguguucuguggcacuuccggaaccuacggcacagggucuuggccugacggagccgaucucaaccugaugccaauuuga

SEQ ID NO: 148269 - RNA, 1410 nt, Artificial Sequence; identical to SEQ ID NO: 148267
  derived and/or modified sequence opt3 from neuraminidase__InfluenzaA__EPI578429

SEQ ID NO: 148270 - RNA, 1410 nt, Artificial Sequence; identical to SEQ ID NO: 148267
  derived and/or modified sequence opt3 from neuraminidase__InfluenzaA__EPI614405

SEQ ID NO: 148271 - RNA, 1350 nt, Artificial Sequence; identical to SEQ ID NO: 148189
  derived and/or modified sequence opt3 from neuraminidase__InfluenzaA__AAT73329

SEQ ID NO: 148272 - RNA, 1350 nt, Artificial Sequence; identical to SEQ ID NO: 148189
  derived and/or modified sequence opt3 from neuraminidase__InfluenzaA__AAW80723

SEQ ID NO: 148273 - RNA, 1350 nt, Artificial Sequence; identical to SEQ ID NO: 148189
  derived and/or modified sequence opt3 from neuraminidase__InfluenzaA__EF541467

SEQ ID NO: 148274 - RNA, 1398 nt, Artificial Sequence; identical to SEQ ID NO: 145470
  derived and/or modified sequence opt3 from neuraminidase__InfluenzaA__EPI439509

SEQ ID NO: 148275 - RNA, 1410 nt, Artificial Sequence
  derived and/or modified sequence opt3 from neuraminidase__InfluenzaA__EPI482776
augaacaccaaucagagaaucauuacaauaggcacugugugcaugaucgucgggauuaucagccugcuccuucaaauuggaaacaucguuucccuguggauaucucacucaauccagacggguugggagaaucauaccgugauguguaaccagaguguaauuacauacgugaauaacacuugggucaauaggaccuaugugaacaucagcaauauuaagaucgccacaauacaggacguuaccuccauuaucuuggcuggcaacucuucguuaugccccgugucagggugggcagucuacagcaaagauaauaguauucggaucggauccaagggcgacaucuucgugauucgcgaaccuuuuauaucuuguagccaacuggagugccgaacuuucuuucuaacacagggugcccuccugaacgauaaacacuccaaugggaccguaaaggaccguucaccauauagaacgcuuaugaguuguccgaucggagaagcgcccagcccuuacaacucuagguucgaguccguugcuuggucagccagcgcaugccaugauggcaugggcuggcugacuauugggaucaguggaccagacaauggugccguggcugucuugaaauauaacggcauaauuaccgauacaaucaagucuuggcggaacaagauccuccgcacucaggaauccgagugugugugcaugaaugggagcuguuuuaccgugcugacagacggacccucgaacggccaggcaucuuacaaaauuuucaaggucgagaaagguaagaucauuaaauccauagaacuggaugccccuaauuaucacuacgaggaaugcucauguuacccagacaccgggaagguuaugugcgugugcagagauaacuggcaugcuaguaauaggcccugggugagcuuuaaccaaaaucucgacuaucagaucggauacauuuguuccggcguguucggcgauaacccucggucuaaugacgggaagggaaacugcgguccagucuuaagcaauggcgccaacggggugaaaggauuuucauaucgcuacggcaaugguguuuggaucgggcgaacgaagaguaucaacuccagaagcggcuucgagaugauuugggacccgaauggauggacugagacagauucuucauuuaguaugaaacaggacauaaucgcgcugaacgauuggagcggcuauuccgggucuuucgugcagcaccccgaacuuaccggaaugaacuguauuaggccuugcuuuugggucgaguugauccggggucaaccaaaggaaucgacuauuugggcaagcggcuccucaaucaguuucugugggguaaauucugagacagccagcugguccuggcccgacggagcugaucugccuuucaccauagacaaauga

SEQ ID NO: 148276 - RNA, 1410 nt, Artificial Sequence
  derived and/or modified sequence opt3 from neuraminidase__InfluenzaA__EPI745533
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccaaauggcuggaccggaacggacaacaauuuuucuaucaagcaagacauugucggcaucaacgaauggucgggguacagcggauccuucgugcagcaucccgagcugacuggucuggauuguauuaaaccuugcuucuggguugaacucauccgaggcagaccaaaggagaauacaauauggaccucagggaguucuaucagcuuuuguggagugaacuccgacacugucggcuggucauggcccgauggugcagaguuaccguucacaauugacaaauga

SEQ ID NO: 148277 - RNA, 1410 nt, Artificial Sequence; identical to SEQ ID NO: 138744
  derived and/or modified sequence opt3 from neuraminidase__InfluenzaA__AEE69012

SEQ ID NO: 148278 - RNA, 1410 nt, Artificial Sequence; identical to SEQ ID NO: 138744
  derived and/or modified sequence opt3 from neuraminidase__InfluenzaA__EPI176609

SEQ ID NO: 148279 - RNA, 1410 nt, Artificial Sequence; identical to SEQ ID NO: 138744
  derived and/or modified sequence opt3 from neuraminidase__InfluenzaA__EPI176472

SEQ ID NO: 148280 - RNA, 1410 nt, Artificial Sequence
  derived and/or modified sequence opt3 from neuraminidase__InfluenzaA__EPI280340
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagauaaucugggauccaaauggcuggaccggaacggacaacaauuuuucuauuaagcaagacaucgucggcauuaacgaauggucgggguacagcggauccuucgugcagcaucccgagcugacuggucuggauuguauccgaccuugcuucuggguugaacucauaagaggcaggccaaaagagaauacaaucuggaccucagggaguucuauuagcuuuuguggagugaacuccgacacugucggcuggucauggcccgauggugcagaguuaccguucacaaucgacaaguga

SEQ ID NO: 148281 - RNA, 1410 nt, Artificial Sequence; identical to SEQ ID NO: 138744
  derived and/or modified sequence opt3 from neuraminidase__InfluenzaA__EPI240318

SEQ ID NO: 148282 - RNA, 1410 nt, Artificial Sequence; identical to SEQ ID NO: 138744
  derived and/or modified sequence opt3 from neuraminidase__InfluenzaA__EPI183133

SEQ ID NO: 148283 - RNA, 1410 nt, Artificial Sequence; identical to SEQ ID NO: 138744
  derived and/or modified sequence opt3 from neuraminidase__InfluenzaA__EPI369141

SEQ ID NO: 148284 - RNA, 1410 nt, Artificial Sequence
  derived and/or modified sequence opt3 from neuraminidase__InfluenzaA__EPI482787
augaacaccaaucagagaaucauuacaauaggcacugugugccugaucgucgggauuguuagccuccuucugcaaaucggaaacauuguguccuuguggaucucucacucaauacagacggguaagaggagucaucccgagaccuguagccagaauguaaucacauacgaaaacaauacuugggugaaccagaccuaugucaauauuuccaacacaaauaucguggacggccaagggguuaccucuauuaucuuagccggaaacucgccucugugcccaauaucaggcugggcuauuuacagcaaagauaauaguauccggauugguuccaagggggacaucuucgugauccgcgagccguuuauuucuuguagccaccuagaaugccgaacuuucuuucucacacagggagcacugcuuaacgaucgucauuccaauggcaccgucaaagacagaucacccuauaggacgcugaugaguuguccuauaggcgaggccccaagccccuacaacucucgguucgaauccguggcguggucagcuagcgccugccacgaugggaugggaugguugacuaucgguauuaguggcccugacaauggggcaguagccguucucaaguauaacggaaucauaaccgauacaauuaaaucuuggcgcaacaagauccugagaacucaggaguccgagugugugugcaucaauggcagcuguuuuaccauuaugacagacgguccaucgaacgggcaggcuucuuacaagaucuucaaaauggaaaagggaaaaauuauaaaguccgucgagcuggaugcacccaauuaucauuacgaagagugcucauguuacccugacaccggcaaaguggugugcgucugcagggauaacuggcacgccaguaaucggccauggguuacguuugaccaaaaccucaauuaucagaucggcuacauuuguagcgggguguucggagauaacccgcgcuccaaugacgguaagggcaacugcgggcccguaccuucuaauggagcuaacggcgugaaggguuuuagcuuccgauaugggaauggcgucuggaucggaagaacuaaaucaaucaguuccaggagcggcuuugagaugauuugggacccaaacggguggacagaaaccgauucuucauucaguauaaagcaggacaucauugccuuaacugauuggagcggauacuccgguucuuuugugcagcaccccgagcugacaggcaugaauuguaucaaaccuugcuucuggguugaacuuauucgggggcaaccaaaggagucgaccaucuggacgagcggauccucaauaaguuucuguggcguggacucugaaaccgucagcugguccuggcccgauggugcggacuugccguuuacaaucgauaaauga

SEQ ID NO: 148285 - RNA, 1410 nt, Artificial Sequence
  derived and/or modified sequence opt3 from neuraminidase__InfluenzaA__EPI482790
augaacaccaaucagagaaucauuacaauaggcacugugugccugaucgucgggauuaucagccuccuucugcaaauuggaaacaugguuuccuuguggaucucucacucaauacagacggguggcaagaaucauaccgagauguguaaccagaaugugaucacauacguaaacaauacuugggugaacaggaccuaugucaauauuaguaacacaaaaaucgugaauguucaggacguggucagcgugauuuuaaccgggaacuccucucugugccccaucucgggaugggccauauacucaaaggauaauagcauucggaucggcaguaaaggugacauuuucguaauccgcgaaccuuuuaucuccuguucucaccuagagugccgaacuuucuuucucacacaaggggcucugcuuaacgauaagcauagcaauggaaccguuaaagaccguuccccauauagaacgcugaugucauguccggugggcgaagcacccaguccuuacaacagcagguucgagucugucgccugguccgcgucagcuugccacgauggcauggggugguugacuauuggaauaagcgguccagacaacggcgccguggcagugcucaaguauaaugggaucauuaccgauacaaucaagaguuggcggaacaaaauacugcgcacucaggaaucugagugugucugcaugaauggauccuguuuuaccguucugacagacggccccagcaacggucaggccucguacaagauuuucaaaauggagaaggggaaaaucaucaagucuauugaacucgaugcuccuaauuaucauuacgaggaaugcuccuguuacccagacgcaggaaaggugaugugcguaugcagagauaacuggcacgccucaaauaggcccugggugaguuuugaccagaacuuagauuaucaaaucggcuacauuuguagcggcgucuucggggacaauccucgguccaacgacggaaaagguaauugcggcccagugcacucuaacggggcuaauggaguuaagggcuuuagcuaucgcuacgguaacgggguguggauaggccgaaccaaaucaaucaauaguagauccggauucgagaugauuugggauccgaacggcuggacggggacugacagcucuuuuucaaugaagcaggauaucaucgcccugacagacuggaguggauauagcgguuccuucguccagcaucccgagcuuaccggcaugaacuguauuaggccuugcuuuuggguggaauugauacgggggcagccaaaagagaauacuaucugggcgucuggaucgagcauuuccuucuguggcguaaacggugaaacagcaucauggaguuggcccgauggggccgaccugccuuucaccaucgauaaguga

SEQ ID NO: 148286 - RNA, 1410 nt, Artificial Sequence
  derived and/or modified sequence opt3 from neuraminidase__InfluenzaA__EPI291797
augaacaccaaucagagaaucauuacaauaggcacugugugcaugaucguggggauuaucagccugcuccuucaaauuggaaacaucguuucccuguggauaucucacucaauccagacggguugggagaaucauaccgaaauguguaaccagagugugauuacauacguaaauaacacuugggugaauaggaccuaugucaacaucagcaauacaaacauugccaccauccaggacgugacuuccauaauuuuggcuggcaauucuucguuaugccccguuucagggugggcaaucuacagcaaggauaacaguauucggaucggauccaaaggcgacaucuucgugauucgcgagccuuuuauaucuuguagccaacuggaaugccgaacauucuuucuaacccagggugcccuccugaaugauaagcacuccaacgggacggucaaagaccguucaccauauagaacucuuaugaguuguccgaucggagaggcgcccagcccuuacaauucuagguucgaauccguggcuuggucagccagcgcaugccaugauggcaugggcuggcugaccauugggaucaguggaccagacaacggugccguagcuguuuugaaguauaacggcauaauuacagauacuaucaaaucuuggcggaauaagauccuccgcacccaggaguccgagugugugugcaugaacgggagcuguuuuacaguccugaccgacggacccucgaauggccaggcaucuuacaagauuuucaaaguggaaaaggguaaaaucauuaaguccauagagcuggaugccccuaacuaucacuacgaagagugcucauguuacccagacacggggaaagugaugugcgucugcagagauaauuggcaugcuaguaacaggcccuggguuagcuuuaaucaaaaccucgacuaucagaucggauacauuuguuccggcguguucggcgauaauccucggucuaacgacgggaagggaaauugcgguccaguauuaagcaacggcgccaauggggugaagggauuuucauaucgcuacggcaacggugucuggaucgggcgaacuaaaaguaucaauuccagaagcggcuucgagaugauuugggacccgaacggauggacagaaaccgauucuucauuuaguaugaagcaggacauaaucgcgcugacugauuggagcggcuauuccgggucuuucgugcagcaccccgagcuuacaggaaugaacuguauuaggccuugcuuuuggguugaauugauccggggucaaccaaaagagucgaccauuugggcaagcggcuccucaaucaguuucuguggggucaauucugaaacggccagcugguccuggcccgacggagcugaucugccuuucaccauagacaaguga

SEQ ID NO: 148287 - RNA, 1410 nt, Artificial Sequence; identical to SEQ ID NO: 148286
  derived and/or modified sequence opt3 from neuraminidase__InfluenzaA__EPI482798

SEQ ID NO: 148288 - RNA, 1410 nt, Artificial Sequence
  derived and/or modified sequence opt3 from neuraminidase__InfluenzaA__EPI638969
augaacaccaaucagagaaucauuacaauaggcacugugugcaugaucgucgggaugauuagccugcuccuucaaaucggauccauuguuucucuguggaucucacacaguauacagacggguugggagaaccauaccggcguguguaaucagagcguaaucacauacgugaacaauacuugggucaacaggaccuaugugaauauuuccaacaucaagauugccacaauccaggacguuacccccauaauuuuggcuggaaauucuucguuaugcccugugaacgggugggcagucuacucaaaagauaauagcauccggauuggcaguaagggugacaucuucgugauccgcgaaccauuuauuuccuguucucaacuggagugccgaacuuucuuucuaacacagggggcccuccugaacgauaaacacagcaauggaaccguaaaggaccguuccccguauagaacgcuuaugucaugucccauaggcgaagcgccuaguccauacaacagcagguucgagucuguugcuugguccgccucagcaugccaugauggcaugggguggcugacuaucggaauuagcggucccgacaauggcgccguggcugucuugaaauauaacgggaucauaaccgauacaauuaagaguuggcggaacaagauccuccgcacucaggaaucugagugugugugcaugaauggauccuguuuuaccgugcugacagacggcccuagcaacggucaggcaucguacaaaaucuucaaggucgagaaagggaagauuaucaaaucuauugaacuggaugccccaaauuaucacuacgaggaaugcuccuguuaccccgacaccggaaagguuaugugcgugugcagagauaacuggcaugcuucaaauaggccuuggguaaguuuuaaccaaaaucucgacuaucagauaggcuacaucuguagcggcguguucggggauaacccacgguccacggacggaaaggguaauugcggcccggucuuaucuaacggggccaauggagugaaaggcuuuagcuaucgcuacgguaacgggguuuggauuggccgaacuaagucaaucaauaguagauccggauucgagaugaucugggaccccaacggcuggacagagaccgauagcucuuuuucaaugaaacaggacauuauagcgcugaaugauuauaguggguacagcggauccuucgugcagcacccugaacuuacugguaugaacuguaucaggccaugcuuuugggucgaguugauucggggccaacccaaggaaucuacaaucugggcaucggggagcuccauuucauucuguggagugaacagugagaccgccucuuggagcuggccugacggcgcugaucugccauucgccaucgacaaauga

SEQ ID NO: 148289 - RNA, 1410 nt, Artificial Sequence
  derived and/or modified sequence opt3 from neuraminidase__InfluenzaA__ABI19012
augaacaccaaucagagaaucauuacaauaggcacugugugccugaucgucgggauuaucagccuccuucugcaaauuggaaacaugguuuccuuguggaucucucacucaauacagacggguggcaagaaucauaccgagauguguaaccagaaugugaucacauacguaaacaauacuugggugaacaggaccuaugucaauauuaguaacacaaaaaucgugaauguucaggacguggucagcgugauuuuaaccgggaacuccucucugugccccaucucgggaugggccauauacucaaaggauaauagcauucggaucggcaguaaaggugacauuuucguaauccgcgaaccuuuuaucuccuguucucaccuagagugccgaacuuucuuucucacacaaggggcucugcuuaacgauaagcauagcaauggaaccguuaaagaccguuccccauauagaacgcugaugucauguccgauuggcgaagcacccaguccuuacaacagcagguucgagucuguggccugguccgcgucagcuugccacgauggcauggggugguugacuauaggaaucagcgguccagacaacggcgccgucgcagugcucaaguauaaugggauuaucaccgauacaauaaagaguuggcggaacaaaauucugcgcacucaggaaucugagugugugugcaugaauggauccuguuuuaccguccugacagacggccccagcaacggucaggccucguacaagaucuucaaaauggagaaggggaaaaucauuaagucuaucgaacucgaugcuccuaauuaucauuacgaggaaugcuccuguuacccagacgcaggaaagguuaugugcgugugcagagauaacuggcacgccucaaauaggcccuggguaaguuuugaccagaacuuagauuaucaaauuggcuacauauguagcggcguguucggggacaauccucgguccaacgacggaaaagguaauugcggcccaguccacucuaacggggcuaauggagugaagggcuuuagcuaucgcuacgguaacgggguuuggaucggccgaaccaaaucaauuaauaguagauccggauucgagaugaucugggauccgaacggcuggacggggacugacagcucuuuuucaaugaagcaggauaucauugcccugacagacuggaguggauauagcgguuccuucgugaggcaucccgagcuuaccggcaugaacuguauacggccuugcuuuugggucgaauugauccgugggcagccaaaagagaauacuauuugggcgucuggaucgagcaucuccuucuguggcgugaacggugaaacagcaucauggaguuggcccgauggggccgaccugccuuucaccauugauaaguga

SEQ ID NO: 148290 - RNA, 1410 nt, Artificial Sequence
  derived and/or modified sequence opt3 from neuraminidase__InfluenzaA__EPI687791
augaaccccaaucagaagaucauuaccauaggcagcaucugcaugacaauugggauggccaaccugauccuccaaauuggaaauaucauauccaucugggugucucacucaauucagaucgguaaccagagucagauugagacuuguaaucaaagcgucaucacguacgaaaacaauaccuggguuaaccagacauaugugaauauauccaacacuaauuucgcugcaagacagucuguagugucggucaaacuugccggcaacucaagccugugcccugugagugggugggcgauuuacuccaaggacaauucuguuaggaucggaagcaaaggcgauguguuugucauucgggagccauucaucuccuguucaccguuggaaugccgcaccuuuuucuuaacacagggugcucugcuaaacgacaagcauaguaaugggaccaucaaagaucgaagccccuaucguacucucaugucuuguccuauuggagaggugccaucccccuacaacucaagauuugaaagcguagccuggagugcaucugccugccacgacggcauaaacuggcugacaaucggcauuuccgggccugauagcggagcuguugcagugcuuaaguauaaugguaucauaaccgacacgauuaagucguggaggaacaauauccugcggacucaagagucugagugugccugcgucaacggcuccuguuucaccaucaugacagaugggccaucagacggacaggcuaguuacaaaauuuuucgcaucgaaaagggcaaaauuauaaagagcguggagaugaaagcccccaauuaucauuacgaagagugcuccuguuacccugauucuagcgagaucacuugcgugugcagagacaacuggcacgguucaaauaggccaugggucaguuucaaccagaauuuggaauaucagaugggguacauuuguuccggaguuuuuggcgauaacccgcggcccaaugacaagaccggcagcugcgggccugugucuucaaacggagcgaaugguguaaagggcuucaguuuuaaauaugggaacggaguguggaucggccgcacaaagagcaucuccucucgaaaagguuucgagaugauuugggauccaaauggguggaccggcacggacaacaaguuuucgauaaaacaagacaucgucggaauuaacgaauggagcggcuacuccgggucauucgugcagcaucccgagcucacuggacuggauuguaucagaccuugcuucuggguugaacugauuaggggucggccagaggagaauacaaucuggaccaguggcucuagcauauccuuuuguggggugaacucagacacugucggauggagcuggcccgauggcgcagaacucccguucacaaucgacaaguga

SEQ ID NO: 148291 - RNA, 1410 nt, Artificial Sequence
  derived and/or modified sequence opt3 from neuraminidase__InfluenzaA__EPI841266
augaaccccaaucagaagaucauuaccauaggcagcaucugcaugacaauugggauggccaaccugauccuccaaauuggaaauaucauauccaucugggugucucacucaauucagaucgguaaccagagucagauugagacuuguaaucaaagcgucaucacguacgaaaacaauaccuggguuaaccagacauaugugaauauauccaacacuaauuucgcugcaagacagucuguagugucggucaaacuugccggcaacucaagccugugcccugugagugggugggcgauuuacuccaaggacaauucuguuaggaucggaagcaaaggcgauguguuugucauucgggagccauucaucuccuguucaccguuggaaugccgcaccuuuuucuuaacacagggugcucugcuaaacgacaagcauaguaaugggaccaucaaagaucgaagccccuaucguacucucaugucuuguccuauuggagaggugccaucccccuacaacucaagauuugaaagcguagccuggagugcaucugccugccacgacggcauaaacuggcugacaaucggcauuuccgggccugauagcggagcuguugcagugcuuaaguauaaugguaucauaaccgacacgauuaagucguggaggaacaauauccugcggacucaagagucugagugugccugcgucaacggcuccuguuucaccaucaugacagaugggccaucagacggacaggcuaguuacaaaauuuuucgcaucgaagagggcaagauuauaaaaagcguggaaaugaaggcccccaauuaucauuacgaggagugcuccuguuacccugauucuagcgaaaucacuugcgugugcagagacaacuggcacgguucaaauaggccaugggucaguuucaaccagaauuuggaguaucagaugggguacauuuguuccggaguuuuuggcgauaacccgcggcccaaugacaaaaccggcagcugcgggccugugucuucaaacggagcgaaugguguaaagggcuucaguuuuaaguaugggaacggaguguggaucggccgcacaaaaagcaucuccucucgaaaggguuucgaaaugauuugggauccaaauggguggaccggcacggacaacaaauuuucgauaaagcaagacaucgucggaauuaacgaguggagcggcuacuccgggucauucgugcagcaucccgaacucacuggacuggauuguaucagaccuugcuucuggguugagcugauuaggggucggccagaggaaaauacaaucuggaccaguggcucuagcauauccuuuuguggggugaacucagacacugucggauggagcuggcccgauggcgcagagcucccguucacaaucgacaaauga

SEQ ID NO: 148292 - RNA, 1410 nt, Artificial Sequence
  derived and/or modified sequence opt3 from neuraminidase__InfluenzaA__EPI291844
augaacaccaaucagagaaucauuacaauaggcacugugugccugaucgucgggauuaucagccuccuucugcaaauuggaacgaugguuuccuuguggaucucucacucaauacagaccgguggcaagaaccauacagagauguguaaucagaacgugaucacuuacguaaauaacaccugggugaauaggacauaugucaacauuaguaauaccaaaaucgugaacguucaggacguggucagcgugauuuuaacuggaaauuccucucugugccccaucucggggugggccauauacucaaaggauaacagcauucggaucggcaguaaaggugacauuuucguaauccgcgaaccuuuuaucuccuguucucaccuagagugccgaacauucuuucucacccaaggggcucugcuuaaugauaagcauagcaacggaacgguuaaagaccguuccccauauagaacucugaugucauguccgauuggcgaagcacccaguccuuacaauagcagguucgagucuguggccugguccgcgucagcuugccacgauggcauggggugguugaccauaggaaucagcgguccagacaacggcgccgucgcagugcucaaguauaacgggauuaucacagauacuauaaagaguuggcggaauaaaauucugcgcacccaggaaucugagugugugugcaugaacggauccuguuuuacaguccugaccgacggccccagcaauggucaggccucguacaagaucuucaaaauggagaaggggaaaaucauuaagucuaucgaacucgaugcuccuaacuaucauuacgaggaaugcuccuguuacccagacgcaggaaagguuaugugcgugugcagagauaauuggcacgccucaaacaggcccuggguaaguuuugaccagaauuuagauuaucaaauuggcuacauauguagcggcguguucggggacaacccucgguccaaugacggaaaagguaacugcggcccaguccacucuaauggggcuaacggagugaagggcuuuagcuauaaauacgguaaugggguuuggaucggccgcacgaagucaauuaacagucgauccggauucgagaugaucugggauccgaauggcuggacugggacagacagcucuuuuucaaugaaacaggauaucauugcccugaccgacuggaguggauauagcgguuccuucgugcagcaucccgagcuuacuggcaugaacuguauaagaccuugcuuuugggucgaauugaucagggggcagccaaaggagaacacaauuugggcgucuggaucgagcaucuccuucuguggcgugaauggugaaaccgcaucauggaguuggcccgauggggccgaccugccuuucacgauugauaaauga

SEQ ID NO: 148293 - RNA, 1410 nt, Artificial Sequence
  derived and/or modified sequence opt3 from neuraminidase__InfluenzaA__EPI558120
augaacaccaaucagagaaucauuacaauaggcacugugugcaugaucgucgggauuaucagccugcuccuucaaauuggaaacaucguuucccuguggauaucucacucaauccagacggguugggagaaucauaccgaaauguguaaccagagugugauuacauacguaaauaacacuuggaugaauaggaccuaugugaacaucagcaauauuaagaucgccacaauacaggacgucaccuccauuguguuggcuggcaacucuucguuaugccccguuucagggugggcaguguacagcaaagauaauaguauccggauuggauccaagggcgacaucuucgucauccgcgagccuuuuauuucuuguagccaacuggaaugccgaacuuucuuucuaacacagggugcccuccugaacgauaaacacuccaaugggaccgugaaggaccguucaccauauagaacgcuuaugaguuguccgauaggagaggcgcccagcccuuacaacucuagguucgaauccguagcuuggucagccagcgcaugccaugauggcaugggcuggcugacuaucgggauuaguggaccagacaauggugccguugcuguguugaaauauaacggcaucauaaccgauacaauuaagucuuggcggaacaagauccuccgcacucaggaguccgagugugucugcaucaaugggagcuguuuuaccgugcugacagacggacccucgaacggccaggcaucuuacaaaauuuucaagguggaaaaagguaagaucauuaaauccauagagcuggaugccccuaauuaucacuacgaagagugcucauguuacccagacaccgggaaggucaugugcaucugcagagauaacuggcaugcuaguaauaggcccuggguuagcuuugaccaaaaccucgauuaucagauuggauacaucuguuccggcguguucggcgacaauccucggucuaacgacgggaagggaaauugcgguccaguauuaagcaacggcgccaauggggugaaaggauuuucauaucgcuacggcaacggugucuggaucgggcgaacgaagaguauuaauuccagaagcggcuucgagaugauaugggauccgaacggauggacugaaacagacucuucauuuaguaugaaacaggauaucauugcgcugaaugacuggagcggcuauuccgggucuuucgugcagcaccccgagcuuaccggaaugaacuguaucaggccuugcuuuuggguugaauugauucggggucaaccaaaggagucgacuaucugggcaagcggcuccucaauaaguuucuguggggugaacucugaaacagccagcugguccuggcccgauggagcugaccugccuuucaccaucgauaaauga

SEQ ID NO: 148294 - RNA, 1410 nt, Artificial Sequence
  derived and/or modified sequence opt3 from neuraminidase__InfluenzaA__EPI564138
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaaagcucagcggcagugcccaacacgucgaagagugcucuugcuauccacgcuacccggggguuagaugugugugcagggacaacuggaaaggauccaaucggcccauaguagauauuaacaucaaggaccacagcaucgugucgucuuacgucuguuccggcuuagugggugacaccccucgcaaaaaugauucaaguagcuccucucauugccuggacccaaacaaugaagaagggggacacggcguuaagggcugggcuuucgaugacgggaacgauguguggaugggacgaacgauuaaugagaccagcagacuugguuaugagacauuuaaagucguggagggcuggucaaaccccaagaguaaauugcagaucaauaggcagguaauuguugaccguggggaucgguccggauacagcggcauauucucuguggaagguaagucauguaucaaccgcugcuuuuaugucgagcugauuagagggaggaaggaagagacugaagugcuauggaccaguaauagcaucgucguguucuguggcacauccggaacuuacggcaccgggucuuggccugacggagccgaucucaaccugaugccaaucuga

SEQ ID NO: 148295 - RNA, 1410 nt, Artificial Sequence
  derived and/or modified sequence opt3 from neuraminidase__InfluenzaA__ANM92825
augaaccccaaucagaagaucauuaccauaggcagcaucugcaugacaauugggauggccaaccugauccuccaaauuggaaauaucauauccaucugggugucucacucaauucagaucgguaaccagagucagauugagacuuguaaucaaagcgucaucacguacgaaaacaauaccuggguuaaccagacauaugugaauauauccaacacuaauuucgcugcaggccagucuguagugucggucaaacuugccgggaacucaagccugugcccugugaguggaugggcgauuuacuccaaggacaauucuguuagaaucggcagcaaaggugauguguuugucauuagggagccauucaucuccuguucaccguuggaaugccggaccuuuuucuuaacacagggggcucugcuaaacgacaagcauaguaauggaaccaucaaagaucgcagccccuaucgaacucucaugucuuguccuauuggcgaggugccaucccccuacaacucacguuuugaaagcguagccuggagugcaucugccugccacgacggcauaaacuggcugacaaucgggauuuccggaccugauagcggugcuguugcagugcuuaaguauaauggcaucauaaccgacacgauuaagucguggagaaacaauauccugaggacucaagagucugagugugccugcgucaacggguccuguuucaccaucaugacagauggaccaucagacggccaggcuaguuacaaaauuuuucggaucgaaaaggguaaaauuauaaagagcguggagaugaaagcccccaauuaucauuacgaagagugcuccuguuacccugauucuagcgagaucacuugcgugugccgcgacaacuggcacgggucaaauagaccaugggucaguuucaaccagaauuuggaauaucagaugggauacauuuguuccggcguuuuuggcgauaacccgaggcccaaugacaagaccgggaacugcggaccugugagcucuaauggugcgaacggcguaaagggguucucauuuaaauauggaaauggcguguggaucggucggacaaagaguaucagcucccgcaaaggguucgagaugauuugggauccaaacggcuggaccggaacggacaacaaguuuucuauaaaacaagacaucgucggcauuaaugaauggucgggguacagcggauccuucgugcagcaucccgagcucacuggucuggauuguauccgaccuugcuucuggguugaacugauuagaggcaggccagaggagaacacaaucuggaccucagggaguucuauauccuuuuguggagugaauagcgacacugucggcuggucauggcccgauggugcagaacucccguucacaaucgacaaguga

SEQ ID NO: 148296 - RNA, 1410 nt, Artificial Sequence
  derived and/or modified sequence opt3 from neuraminidase__InfluenzaA__EPI291694
augaacaccaaucagagaaucauuacaauaggcacugugugccugaucgucgggauuguuagccuccuucugcaaaucggaaacauuguguccuuguggaucucucacucaauacagacgggugagaagaaucauagugaaguauguaaccagaauaucauuaccuacgagaacaaaacaugggugaaucagacuuaugucaacaucagcaauaccaacauugccgaaggccaaggggugacauccaucauauuagcuggaaauucuucgcugugccccguuucaggcugggcaauuuacagcaaggacaacaguaucaggauugguuccaaaggggauaucuucgugauccgggagccuuuuauuucuuguagccaccuagaaugccgcaccuucuuucucacucagggagcccugcuuaaugaccgacauuccaacggcacagucaaggaucguucaccauauagaacccugaugaguuguuugacgggcgaggcgccgagccccuacaauucuagguucgaguccguggcuuggucagccagcgcaugccacgacgggaugggauggcucacuauagguaucaguggcccugauaacggggccguagcuguucugaaauauaacggaauuaucaccgacacaauaaagucuuggcggaauaagauucugcgcacucaggaauccgagugugugugcaucaacggcagcuguuuuaccaucaugacagaugguccaucgaaugggcaggcaucuuacaaaauuuucaagauggaaaaaggaaagaucauuaaauccgucgagcucgacgcccccaacuaucauuacgaggaaugcucauguuacccugauaccggcaagguggugugcgucugcagagacaauuggcacgcuaguaacaggccauggguuagcuuugaucaaaauuuagacuaucagauaggcuacaucuguuccgggguguucggagauaacccccggucuaaugacgguaagggcaacugcgggccuguaccaagcaauggagccaacggcgugaaagguuuuucauuccgcuaugggaauggcgucuggauuggacgaacgaagaguaucaucuccagaagcggcuuugagaugauuugggacccgaacggguggacugaaacagauucuucauucaguauaaaacaggacaucauugcgcugaccgauuggagcggauacuccgguucuuuugugcagcaccccgagcuuacuggcaugaauuguaucaggccuugcuucuggguugaauugauucgggggcaaccaaaggagucgacaaucuggaccagcggauccucaauaaguuucuguggcguggacucugagacggcaagcugguccuggcccgauggugccgaccugccuuuuaccaucgauaaauga

SEQ ID NO: 148297 - RNA, 1410 nt, Artificial Sequence; identical to SEQ ID NO: 139230
  derived and/or modified sequence opt3 from neuraminidase__InfluenzaA__EPI241027

SEQ ID NO: 148298 - RNA, 1410 nt, Artificial Sequence; identical to SEQ ID NO: 138754
  derived and/or modified sequence opt3 from neuraminidase__InfluenzaA__EPI177405

SEQ ID NO: 148299 - RNA, 1410 nt, Artificial Sequence; identical to SEQ ID NO: 138754
  derived and/or modified sequence opt3 from neuraminidase__InfluenzaA__EPI242475

SEQ ID NO: 148300 - RNA, 1410 nt, Artificial Sequence
  derived and/or modified sequence opt3 from neuraminidase__InfluenzaA__EPI590131
augaacgccaaucagagaaucauuaccauaggcacagugugccugaucauugggaucauuagccuccuucugcaaaucggaaacauggucuccuuguggauaucucacucaauccagacugguggcaagaaucauacggagauguguaaccagaauguuauuaccuacgugaacaauacauggguaaacaggacuuaugugaauaucaguaacaccaaaauugucaaugugcaggacguugugagcgucaucuuaacagggaacuccucucugugcucgauaucaggaugggcuauuuacagcaaggauaauaguauccggauuggcuccaaaggugacaucuucgugauccgcgaacccuuuauuucuuguagccaccuagagugccgaaccuucuuucucacucaaggggcacugcuuaacgauaagcauuccaauggaacaguaaaagaccguucaccuuauagaacccugaugaguuguccaauaggcgaagccccgagccccuacaacucuagguucgaguccguugcguggucagcuagcgccugccacgauggcaucgggugguugacgauuggaaucagugguccugacaacggcgcaguggccguccucaaguauaaugggauaauuacugauaccaucaagucuuggcggaacaaaauccugcgcacacaggaauccgagugugugugcaugaauggaagcuguuuugcugugcugacugacggcccaucgaacggucaggcaucuuacaagauuuucaaagucaagcaggggaaaaucauuaaguccauagagcucgaugcccccaauuaucauuacgaagagugcucauguuacccugacgcuggaaagguuaugugcgugugcagagauaacuggcacgccaguaauaggccaugggugagcuuugaccaagauuuaaacuaucagaucggcuacauuuguuccggcguauucggggacaauccccggucuaacgacggaaaagguaauugcggcccuguccacagcaacggggcgaauggagugaagggcuuuucauaucgcuacgguaacgggguuuggaucggccgaaccaaaaguauccauuccagaagcggauucgaaaugauuugggauccaaauggcuggacagggaccgacucuucauuuaguaugaagcaggauauaaucgcacugacggacuggagcggauauuccgguucuuucgugcagcacccggagcuuacuggcaugaacuguauuaggcccugcuuuugggucgaguugauccgggggcaaccuaaagaaaacacaauuugggccucgggaagcuccaucucauucuguggcgugaauggugagaccgcuaguuggucuuggccagauggggccgaccugcccuucacuauagauaaguga

SEQ ID NO: 148301 - RNA, 1410 nt, Artificial Sequence
  derived and/or modified sequence opt3 from neuraminidase__InfluenzaA__EPI68596
augaacaccaaucagagaaucauuacaauaggcacugugugccugaucgucgggauuguuagccuccuucugcaaaucggaaacauuguguccuuguggaucucucacucaauacagacgggugagaagaaucauagugaaaucuguagccagaacguaauuaccuacgagaauaacacaugggugaaucagacuuaugucaacaucuccaauaccaacauugccgacggccaaggggugacaucuaucauauuagcuggaaauucgucacugugccccauuagcggcugggcaaucuacaguaaagauaacuccauuaggaucgguucuaagggggacaucuucguuauucgggaaccuuuuauaagcuguucccaccuagagugccgcaccuucuuucucacucagggagcccugcuuaaugaucgacauucaaacggcacagugaaagaccguaguccauauagaacccugaugagcuguccgaucggcgaagcgcccucuccuuacaauuccagguucgagucagucgcuuggagcgccagugcaugccacgaugggaugggaugguugacgauugguaucucuggcccagacaacggggccguggcuguacucaaguauaacggaauaauuacugauaccaucaaauccuggcggaauaagauccugcgcacacaggagagcgaauguguuugcauuaacggcucguguuuuacuaucaugaccgacggucccucuaaugggcaggcauccuacaagauuuucaaaauggagaagggaaaaauaaucaagucaguggaacuggaugccccuaacuaucauuacgaggagugcaguuguuacccagacacaggcaaagucgugugcgugugcagagauaauuggcacgcuagcaacaggcccugggucuccuuugaccaaaaucucgauuaucagauuggcuacaucuguucugggguuuucggagacaacccucggagcaaugacgguaagggcaacugcgggccaguguuaucaaauggagccaacggcguaaaggguuuuaguuuccgcuaugggaauggcguguggaucggacgaaccaaauccauuagcucuagaucaggcuuugaaaugauaugggauccgaacggguggacggagacugacaguagcuucuccaucaagcaggauauuaucgcgcugacagacuggucuggauacucggguagcuuuguccagcaccccgaacuuaccggcaugaauuguauuaggccuugcuucuggguggaguugauccgggggcaaccaaaagaauccacuauauggacaucaggaaguucuaucagcuucuguggcguugauuccgagaccgcaucauggagcuggcccgacggugccgaucugccuuuuacgauugacaaguga

SEQ ID NO: 148302 - RNA, 1365 nt, Artificial Sequence; identical to SEQ ID NO: 137735
  derived and/or modified sequence opt3 from neuraminidase__InfluenzaA__EPI115409

SEQ ID NO: 148303 - RNA, 1365 nt, Artificial Sequence; identical to SEQ ID NO: 137735
  derived and/or modified sequence opt3 from neuraminidase__InfluenzaA__ABD77678/m1

SEQ ID NO: 148304 - RNA, 1410 nt, Artificial Sequence; identical to SEQ ID NO: 138744
  derived and/or modified sequence opt3 from neuraminidase__InfluenzaA__EPI185224

SEQ ID NO: 148305 - RNA, 1410 nt, Artificial Sequence; identical to SEQ ID NO: 148260
  derived and/or modified sequence opt3 from neuraminidase__InfluenzaA__EPI697745

SEQ ID NO: 148306 - RNA, 1410 nt, Artificial Sequence; identical to SEQ ID NO: 148260
  derived and/or modified sequence opt3 from neuraminidase__InfluenzaA__EPI768524

SEQ ID NO: 148307 - RNA, 1410 nt, Artificial Sequence
  derived and/or modified sequence opt3 from neuraminidase__InfluenzaA__EPI726929
augaaccccaaucagaagaucauuaccauaggcagcaucuccaugacaauugggauggccaaccugauccuccaaauuggaaauaucauaucuaucugggugucacacaguauucagaucgguaaccagagccagauugagacuugcaaucaauccgucaucacguacgaaaacaauaccuggguuaaccagacauaugugaauauaucuaacacuaauuucgcugcaggccagucgguagugucagucaaacuugccgggaacagcagucuguguccuguguccggaugggcgauuuacucuaaggacaauagcguuagaaucggcuccaaaggugauguguuugucauuagggagccauucaucucaugcaguccguuggaaugucggaccuuuuucuuaacacagggggcucugcuaaacgacaagcauagcaauggaaccaucaaagaucgcucucccuaucgaacucucauguccugcccuauuggcgaggugccaucacccuacaacagccguuuugaaaguguagccuggucugcauccgccugucacgacggcauaaacuggcugacaaucgggauuagcggaccugauucgggugcuguugcagugcuuaaguauaauggcaucauaaccgacacgauuaagucuuggagaaacaauauccugaggacucaagaguccgagugcgccugugucaacgggucaugcuucaccaucaugacagauggaccaagugacggccaggcuagcuacaaaauuuuucggaucgaaaaggguaaaauuauaaaguccguggagaugaaagcccccaauuaucauuacgaagaguguucuugcuacccugauagcucagagaucacuugugugugccgcgacaacuggcacgggaguaauagaccaugggucuccuucaaccagaauuuggaauaucagaugggauacauuugcagcggcguuuuuggcgauaacccgaggcccaaugacaagaccgggucuuguggaccugugucaaguaacggugcgaauggcguaaagggguucagcuuuaaauauggaaacggcguguggaucggucggacaaaguccaucucuucgcgcaaaggguucgagaugauuugggauccaaauggcuggaccggaacggacaacaaguuuagcauaaaacaagacaucgucggcauuaacgaaugguccggguacucaggaaguuucgugcagcaucccgagcucacuggucuggauugcauccgaccuuguuucuggguugaacugauuagaggcaggccagaggagaauacaaucuggaccucugggagcuccauaucauuuugcggagugaacagcgacacugucggcuggucuuggcccgauggugcagaacucccguucacaaucgacaaguga

SEQ ID NO: 148308 - RNA, 1410 nt, Artificial Sequence; identical to SEQ ID NO: 148307
  derived and/or modified sequence opt3 from neuraminidase__InfluenzaA__EPI813816

SEQ ID NO: 148309 - RNA, 1410 nt, Artificial Sequence
  derived and/or modified sequence opt3 from neuraminidase__InfluenzaA__EPI466627
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagucuguggucucggugaaacuggccgggaacagcagcuugugcccuguuaguggaugggcgaucuacuccaaggacaauucugugagaauaggcagcaaaggugaugucuuugugauuagggagccauucaucuccuguucaccguuagaaugccggaccuuuuuccugacacagggggcucuacucaacgacaagcauaguaauggaaccauuaaagaucgcagccccuaucgaacucugaugucuuguccuaucggcgagguaccaucccccuacaacucacguuuugaaagcguugccuggagugcaucugccugccacgacggcaucaacuggcuuacaauugggauauccggaccugauagcggugcuguggcaguccugaaguauaauggcaucauuaccgacacgaucaagucguggagaaacaauauauugaggacucaagagucugagugugccugcgugaacggguccuguuucaccauuaugacagauggaccaucagacggccaggcuaguuacaaaaucuuucggaucgaaaaggguaaaauugugaagucagucgagaugaaugcccccaacuaucauuacgaagagugcuccuguuacccugauucuagcgagaucacuugcguuugccgcgacaauuggcacgggucaaacagaccaugggugaguuucaaucagaaccucgaauaucagauuggauacauauguuccggcguauuuggcgauaauccgaggcccaacgacaaaaccgggagcugcggaccugugucuucaaauggugcgaacggcgucaagggguucaguuuuaaguauggaaauggcguguggaucggucggacaaaaagcauuuccucucgcaagggguucgagaugaucugggauccaaacggcuggaccggaacggacaacaauuuuucgaucaaacaagacauuguuggcauaaacgaauggagcggguacuccggaucauucgugcagcaucccgagcugacuggucuggauuguauccgaccuugcuucugggucgaacucauuagaggcaggccagaggagaauacaaucuggaccagugggucuagcauuuccuuuuguggagugaacucagacacuguaggcuggagcuggcccgauggugcagaauuaccguucacaaucgacaaguga

SEQ ID NO: 148310 - RNA, 1410 nt, Artificial Sequence
  derived and/or modified sequence opt3 from neuraminidase__InfluenzaA__EPI541965
augaaccccaaucagaagaucauuaccauaggcagcgugugcaugacaaucgggauggccaaccugauucuccaaaucggaaauauuaucuccauaugggucucucacucaauccagcuugguaaccagagucagauugagacuuguaaucaaagcguuaucacguacgaaaacaauaccugggugaaccagacauauguaaauauuuccaacacuaauuucgcugcaggccagccuguggucucugugaaacuggccgggaacucgucauugugcccaguuagcggaugggcgaucuacaguaaggacaauuccgugagaauaggcucuaaaggugaugucuuugugauuagggagccguucaucagcuguucccccuuagaaugccggaccuuuuuccuggcucagggggcccuacucaacgacaagcauucaaauggaacaauuaaagaucgcaguccuuaucgaacccugaugagcuguccaaucggcgagguacccucuccuuacaacucccguuuugaaucaguugcauggagcgccagugcuugccacgacggcaucaacuggcuuacuauugggauaucuggaccagauuccggugcaguggccguccugaaguauaauggcaucauuacagacaccaucaagagcuggagaaacaauauauugaggacgcaagagucggagugugcuugcgugaacgggucuuguuucacuauuaugaccgauggacccuccgacggccaggccucauacaaaaucuuucggaucgaaaaggguaaaauugugaagagugucgagaugaaugcgccuaacuaucauuacgaagagugcagcuguuacccagauuccucugagaucacaugcguuugccgcgacaauuggcacgggagcaacagaccgugggugucauucaaucagaaccucgaauaucagauuggauacauauguaguggcguauuuggcgauaaucccaggccuaacgacaaaacuggguccugcggaccagugagcucuaauggugcaaacggcgucaagggguucucauuuaaguauggaaauggcguguggaucggucggaccaaaaguauuagcucccgcaagggguucgagaugaucugggaucccaacggcuggacaggaaccgacaacaauuuuucuaucaaacaagacauuguuggcauaaacgaauggucgggguacagcggauccuucgugcagcauccugagcugacgggucuggauuguauccgaccaugcuucugggucgaacucauuagaggcaggcccgaggagaauacuaucuggacaucagggaguucuauuagcuuuuguggagugaacuccgacaccguaggcuggucauggccggauggugccgaauuaccuuucacuaucgacaaguga

SEQ ID NO: 148311 - RNA, 1410 nt, Artificial Sequence
  derived and/or modified sequence opt3 from neuraminidase__InfluenzaA__EPI652004
augaaccccaaucagaagaucauuaccauaggcagcgugugcaugacaaucgggauggccaaccugauucuccaaaucggaaauauuaucuccauaugggucucucacucaauccagauugguaaccagagucagaucgagacuuguaaucaaagcguuauuacguacgaaaacaauaccugggugaaccagacauauguaaauaucuccaacacuaauuucgcugcaggccagucuguggucucggugaaacuugccgggaacucaagccugugcccuguuaguggaugggcgauauacuccaaggacaauucugugagaauuggcagcaaaggugaugucuuugugaucagggagccauucauuuccuguucaccguuggaaugccggaccuuuuucuuagcucagggggcccugcuaaacgacaagcauaguaauggaacaaucaaagaucgcagccccuaucgaacccucaugucuuguccuaucggcgagguaccaucccccuacaacucacguuuugaaagcguugcauggagugccucugcuugccacgacggcauuaacuggcugacuauagggaucuccggaccugauagcggugcaguggccguccuuaaguauaauggcauuaucacagacaccauaaagucguggagaaacaauauucugaggacgcaagagucugagugugcuugcgugaacggguccuguuucacuaucaugaccgauggaccaucagacggccaggccaguuacaaaaucuuucggauugaaaaggguaaaaucgucaagagcguggagaugaaugcgcccaacuaucauuacgaagagugcuccuguuacccugauucuagcgagauuacaugcguuugccgcgacaauuggcacgggucaaacagaccaugggugaguuucaaucagaacuuggaauaucagauaggauacaucuguuccggcguauuuggcgauaauccgaggcccaacgacaaaacugggagcugcggaccugugucuucaaauggugcaaacggcgucaagggguucaguuuuaaguauggaaauggcguguggauuggucggaccaaaagcaucuccucucgcaagggguucgagaugaucugggauccaaacggcuggacaggaaccgacaacaauuuuucgauuaaacaagacauaguuggcaucaacgaauggagcggguacuccggaucauucgugcagcaucccgagcucacgggucuggauuguauucgaccuugcuucugggucgaacugaucagaggcaggccagaggagaauacuauuuggacaagugggucuagcaucuccuuuuguggagugaacucagacaccguaggcuggagcuggcccgauggugccgaacucccguucacuauagacaaguga

SEQ ID NO: 148312 - RNA, 1410 nt, Artificial Sequence
  derived and/or modified sequence opt3 from neuraminidase__InfluenzaA__EPI62526
augaacaccaaucagagaaucauuacaauaggcacugugugccugaucgucgggauuguuagccuccuucugcaaaucggaaacauuguguccuuguggaucucucacucaauacagacgggugagaagaaucaucccgaaaucuguagucagaacguaauuaccuacgagaauaacacaugggugaaucagacuuaugucaacaucagcaauaccaacauuguggacggccaagggguuacauccaucauauuagccggaaauucuucgcugugcccuauuucaggcugggcuaucuacagcaaagauaacaguauuaggaucgguuccaagggggacaucuucgugauucgggaaccauuuauaucuuguagccaccuagagugccgcaccuucuuucucacucagggagcacugcuuaaugaucgacauuccaacggcacagucaaagaccguucaccguauagaacccugaugaguugucccaucggcgaagccccuagcccauacaauucuagguucgaguccguggcguggucagcuagcgccugccacgaugggaugggaugguugacgauugguaucaguggccccgacaacggggcaguagccguucucaaguauaacggaauaauuacugauaccaucaaaucuuggcggaauaagauccugcgcacacaggaguccgaaugugugugcauuaacggcagcuguuuuacuaucaugaccgacgguccuucgaaugggcaggcuucuuacaagauuuucaaaauggagaagggaaaaauaaucaaguccgucgaacuggaugcaccaaacuaucauuacgaggagugcucauguuaccccgacacaggcaaaguggugugcgucugcagagauaauuggcacgccaguaacaggccuuggguuagcuuugaccaaaaucucgauuaucagauuggcuacaucuguuccgggguguucggagacaacccacggucuaaugacgguaagggcaacugcgggccgguauuaagcaauggagcuaacggcgugaaggguuuuucauuccgcuaugggaauggcgucuggaucggacgaaccaaaaguauuuccagcagaucuggcuuugaaaugauaugggaucccaacggguggacggagacugacucaaguuucagcaucaagcaggauauuaucgcccugacagacugguccggauacucugguucguuugugcagcacccugaacuuaccggcaugaauuguauuaggccaugcuucuggguugaguugauccgggggcaacccaaagaaagcacuauauggacauccggaucaaguaucucuuucuguggcguggauagcgagaccgcguccuggucauggccugacggugcagaucugccauuuacgauugacaaguga

SEQ ID NO: 148313 - RNA, 1410 nt, Artificial Sequence; identical to SEQ ID NO: 138744
  derived and/or modified sequence opt3 from neuraminidase__InfluenzaA__EPI189183

SEQ ID NO: 148314 - RNA, 1410 nt, Artificial Sequence; identical to SEQ ID NO: 138744
  derived and/or modified sequence opt3 from neuraminidase__InfluenzaA__EPI180576

SEQ ID NO: 148315 - RNA, 1410 nt, Artificial Sequence
  derived and/or modified sequence opt3 from neuraminidase__InfluenzaA__EPI346918
augaacaccaaucagagaaucauuacaauaggcacugugugcaugaucgucgggauuaucagccugcuccuucaaauuggaaacaucguuucccuguggauaucucacucaauccagacggguugggagaaucauaccgaaauguguaaccagaaugugauuacauacguaaacaauacuugggugaacaggaccuaugucaaugugaguaacacaaauaucgccaccauucaggacguuacuagcaucguguuggcuggcaacuccucuuuaugccccgucucggggugggcaauauacucaaaggauaauagcauucggaucggaaguaaaggcgacauuuucgugauccgcgagccuuuuaucuccuguucucaacuggaaugccgaacauucuuucuaacccagggugcccuccugaacgauaagcacagcaaugggacgguaaaagaccguuccccauauagaacucuuaugucauguccgauuggagaggcgcccaguccuuacaacagcagguucgaaucuguugcuugguccgccucagcaugccaugauggcaugggcuggcugaccauagggaucagcggaccagacaacggugccguggcugucuugaaguauaauggcauuaucacagauacuauaaaaaguuggcggaacaagauucuccgcacccaggagucugagugugugugcaugaauggguccuguuuuacagugcugaccgacggacccagcaacggccaggcaucguacaagaucuucaaagucgaaaaggguagaaucauuaaaucuaucgagcuggaugccccuaauuaucacuacgaagagugcuccuguuacccagacacggggaagguuaugugcgugugcagggauaacuggcaugcuucaaaucggcccuggguaaguuuuaaccaaaaucucgacuaucagauuggauacauauguagcggcguguucggcgauaacccucgcuccaaugacgggaaaggaaacugcgguccagucuuaucuaauggcgccaacggggugaagggauuuagcuaucgauacggcaaugguguuuggaucgggagaacuaagucaauuaacaguaggcggggcuucgagaucaucugggacccgaacggauggacagaaaccgauuccagcuuuucuaugaaacaggacauuauagcgcugacugauuggucaggcuauagugggagcuucgugcagcaccccgagcuuacaggaaugaauuguauccguccuugcuuuugggucgaauugauucgcggucaaccaaaggaguccaccaucugggcaucuggcucgagcauuuccuucuguggggugaacucagaaacggccaguuggucuuggcccgacggagcugaucugccuuucaccaucgacaaauga

SEQ ID NO: 148316 - RNA, 1410 nt, Artificial Sequence; identical to SEQ ID NO: 139332
  derived and/or modified sequence opt3 from neuraminidase__InfluenzaA__EPI240976

SEQ ID NO: 148317 - RNA, 1410 nt, Artificial Sequence; identical to SEQ ID NO: 136111
  derived and/or modified sequence opt3 from neuraminidase__InfluenzaA__EPI3165

SEQ ID NO: 148318 - RNA, 1410 nt, Artificial Sequence; identical to SEQ ID NO: 148037
  derived and/or modified sequence opt3 from neuraminidase__InfluenzaA__EPI957

SEQ ID NO: 148319 - RNA, 1410 nt, Artificial Sequence; identical to SEQ ID NO: 144162
  derived and/or modified sequence opt3 from neuraminidase__InfluenzaA__EPI507593

SEQ ID NO: 148320 - RNA, 1410 nt, Artificial Sequence; identical to SEQ ID NO: 144162
  derived and/or modified sequence opt3 from neuraminidase__InfluenzaA__EPI461954

SEQ ID NO: 148321 - RNA, 1410 nt, Artificial Sequence; identical to SEQ ID NO: 144162
  derived and/or modified sequence opt3 from neuraminidase__InfluenzaA__EPI461954

SEQ ID NO: 148322 - RNA, 1410 nt, Artificial Sequence
  derived and/or modified sequence opt3 from neuraminidase__InfluenzaA__EPI668104
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuuuaccuggguaccaaacaggugugcauugcuuggagcaguuccucuugucacgaugggaaggccugguugcaugucugcaucacaggagacgauaagaacgcaaccgccagcuucaucuauaauggcaggcucguggacuccguaguuucauggaguaaagauauucugcggacgcaggagagcgaaugugugugcauaaacggcacuuguacagucgugaugaccgacgggaacgcuucuggaaaggcagauacuaaaauccuguuuauugaggaggguaagaucgugcacacauccaagcucucaggcagcgcccaacaugucgaagagugcaguugcuacccacgcuacccggggguuagaugugugugcagggacaauuggaaaggaucuaaccggcccauaguagauauuaauaucaaggaccacuccaucgugagcucguaugucuguucuggcuuagugggugacaccccucgcaaaaacgauuccucaaguagcucccacugccuggacccaaauaacgaagaagggggacauggcguuaagggcugggcuuucgaugacgggaaugauguguggaugggacgaacgauuaacgagaccucuagacuugguuacgagacauuuaaagucguggagggcuggagcaaucccaagucaaaauugcagaucaacaggcagguaauuguugaccguggggaucggaguggauauuccggcauauucagcguggaagguaagucuuguaucaaucgcugcuuuuacgucgagcugauuagagggaggaaggaagagacugaagugcuauggaccucaaacaguaucgucguguucuguggcacaagcggaacuuauggcaccggguccuggccugacggagccgaucucaaucugaugccaaucuga

SEQ ID NO: 148323 - RNA, 1410 nt, Artificial Sequence
  derived and/or modified sequence opt3 from neuraminidase__InfluenzaA__EPI578445
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggaacgcuucuggaaaggcagauacuaaaauccuguuuauugaggaggguaagaucgugcauacauccaagcucucaggcagcgcccaacacgucgaagagugcaguugcuauccacgcuacccggggguuagaugugugugcagggacaauuggaaaggaucuaaccggcccauaguagauauuaauaucaaggaccacuccaucgugagcucguacgucuguucuggcuuagugggugacaccccucgcaaaaacgauuccucaaguagcucccauugccuggacccaaauaacgaagaagggggacacggcguuaagggcugggcuuucgaugacgggaaugauguguggaugggacgaacgauuaacgagaccucuagacuugguuaugagacauuuaaagucguggagggcuggagcaaucccaagucaaaauugcagaucaacaggcagguaauuguugaccguggggaucggaguggauacuccggcauauucagcguggaagguaagucuuguaucaaucgcugcuuuuaugucgagcugauuagagggaggaaggaagagacugaagugcuauggaccucaaacaguaucgucguguucuguggcacaagcggaacuuacggcaccggguccuggccugacggagccgaucucaaucugaugccaaucuga

SEQ ID NO: 148324 - RNA, 1410 nt, Artificial Sequence; identical to SEQ ID NO: 148323
  derived and/or modified sequence opt3 from neuraminidase__InfluenzaA__EPI551883

SEQ ID NO: 148325 - RNA, 1410 nt, Artificial Sequence
  derived and/or modified sequence opt3 from neuraminidase__InfluenzaA__EPI344388
augaaccccaaucagaagaucauuaccauaggcagcgugucccugaucauugccacaaucugcuuccucaugcaaauugcuauccuugucacuacgguuacccugcacuuuaaacagcaugacuacaacucuccuccaaauaaccaggcaauguugugugagccgacaauaaucgaaagaaauacuaccgagauuguguauuuaacaaacaccacuaucgaaaaggagauuugccccaaacuggccgaauacaggaauuggucaaagccucaguguaacaucacaggguucgcgccauuuaguaaagauaauagcauacggcuauccgcuggaggugacauuuggguaacccgcgagcccuaugugucuugcgauccugacaaguguuaccaauucgcccucggccaggggacgacucugaacaauggacacucgaacaauaccguccaugaucgaacaccauaucguacucuucugaugaacgaguugggcgugcccuuucaccucgguaccagacagguuugcauggcauggucaagcaguuccugucaugacgggaaggccuggcugcacgugugcaucacaggaaaugauaacaacgcuaccgcaucuuucauuuacaauggcaggcuggucgacagcaucggcuccuggaguaaaaacauccuccggacgcaggaaagugagugugugugcauuaaugggacuuguacaguaguuaugaccgauggaagcgccucugguaaggcugacacuaaaauauuauuuguggaagagggcaagaucguccacauuuccacacugucagggagcgcccaacauguggaggaaugcaguugcuauccucgcuucccaggagugagaugugucugcagggauaacuggaaaggcucuaaucggccgaucguugacauaaacgugaagaauuacuccauuguaagcucguacguguguucuggucuugucggggauacccccaggaaguccgacucagugaguagcuccuauugcuuggacccuaacaaugagaaaggaggccacggcguuaaggggugggcguuugaugacggaaacgauguguggaugggucgaacgaucaaugaaacccugagacuaggcuacgagacauucaaagucaucgaaggguggucuaaggcaaacagcaaacuccagacuaaucgccaggugauuguagagaagggagaccggucaggcuauagugguaucuuuuccguugaggggaaaagcuguauuaaccguugcuucuacguggaacugauacgcggcagaaaggaggaaaccaaggucugguggacaucuaauucaaucguggucuuuuguggaacuucaggcaccuaugggacaggaagcuggccagauggugccgacauuaaccuuaugcccaucuga

SEQ ID NO: 148326 - RNA, 1410 nt, Artificial Sequence; identical to SEQ ID NO: 148325
  derived and/or modified sequence opt3 from neuraminidase__InfluenzaA__EPI347601

SEQ ID NO: 148327 - RNA, 1410 nt, Artificial Sequence
  derived and/or modified sequence opt3 from neuraminidase__InfluenzaA__EPI642512
augaaccccaaucagaagaucauuaccauaggcagcaucucccugauuaucgccacaauuugcuuccucaugcaaaucgcuauacuugugaucacugucacgcugcacuuuaaacagcauaacugugacucuucaccuaauaaccagguuauguucugcgagccaaccauuaucgaaagaaauaagacagagauuguguacuugaucaacacuaccguagaaaaagagauauguccgaagcccacagaauauaggaauuggaguaaaccucagugcaacauuaccggguuugcaccauucagcaaggauaauuccauccgguuaucugccggaggugacauuugggugacucgcgagcccuacgucucgugugauccugacaagugcuaucaauuugcgcugggccaggggacaacccuaaacaauggacacucaaacgauacggugcaugaccgaacuccauaccguacccuccugaugaaugagcuuggcguucccuuccaccuggguacaagacagguguguaucgcuuggagcaguuccucuugccaugaugggaaagccugguugcacgucuguaucacuggagacgauggcaacgcaaccgccagcuuuauuuauaauggcaggcucguggacuccauagggucauggaguaagaacauccugcggacacaggaaagcgagugcguauguauuaacggaaccugcacgguugugaugacugaugguucugcuuccggcaaagcagacacaaagauccuguucauagaagaggggaaaauuauccacaucucaacccucagcggaagugcccaacaugucgaggaaugcucuuguuacccucgcuauccaggcgugagaugcguguguagggauaauuggaaggguuccaaccggccgauugucgacaucaauguuaaggacuacagcauugugucgucuuacguaugcuccggguuagugggagauacuccccgcaaaaacgacucauuuaguagcucccacugucuggauccuaauaacgaggaaggcggccauggggucaagggaugggcuuucgacgaugguaaugacguguggaugggccgaacaauaucugagaaaagcagacuuggguaugaaaccuuuaagguugugaaaggauggucagagccaaacaguaaguugcagacgaauaggcaggucaucgugggccgggguaaccguuccggguacagcggcauuuucucuaucgagggcaaaaauugcaucaaccgcuguuuuuauguagaacugauuagaggaaggaaggaggaaaccaagguuugguggacaucaaauaguauaguggucuucugcgggacuagcggaaccuacgguacaggcuccuggcccgauggggccgacaucaaccuaaugccuauuuga

SEQ ID NO: 148328 - RNA, 1410 nt, Artificial Sequence
  derived and/or modified sequence opt3 from neuraminidase__InfluenzaA__AIE52540
augaaccccaaucagaagaucauuaccauaggcagcgugucccugaucauugccacaaucugcuuccucaugcaaauugcuauccuugucacuacgguuacccugcacuuuaaacagcaugacuacaacucuccuccaaauaaccaggugauguugugugagccgacaauaaucgaaagaaauacuaccgagauuguauauuuaacaaacaucaccauugaaaaggagaucugccccaaacuggcagaauacaggaauuggucaaagccucaguguaacauaacuggguucgccccauuuaguaaagauaauagcauucggcuauccgcgggaggugacaucugggugacacgcgagcccuaugucucuugcgauccugacaaguguuaccaauucgcucucggccaggggaccacgcugaacaaucgacacucgaacaauacugugcaugaucguucaccauauagaacccuucugaugaacgaguugggaguucccuuucaccucggcacaaggcaagugugcauugccuggagcaguuccucuugucaugacgguaaggcauggcugcacgucugcaucacuggggaugacaauaacgccaccgcuagcuucaucuacaacggacggcugguggauuccauuggcucauggaguaaaaauauacuccgcacacaggaaagcgaguguguaugcaucaacggcaccuguacgguugugaugacugacgggucugcauccggaaaggccgauacaaaaauuuuauuuaucgaagaggguaagauaguccacauuucaacccugagcggcagugcucagcauguggaggaaugcucuugcuauccuagauacccaggggugaggugugucugccgggacaauuggaaaggauccaaccgcccgaucguugauaucaauaugaaggacuacagcauugccucgucuuauguguguuccggccuuguaggugacacuccccgaaagaacgauucauucaguagcucccacugcuuggacccuaauaacgagaaagggggacauggcgugaagggcugggcguuugaugacgggaaugaugucuggaugggaagaacaaucucugaagaguucaggcuggguuacgaaaccuuuaaagugauuaagggcuggagcaacccaaauucaaaacuacagacgaaccggcagguuauaguggagaaggggaaucguaguggauauuccggcgucuucagcaucgaggacaaaucuuguauuaaccgcugcuuuuacguggaacucaucagagguaggaaggaggaaaccaagguaugguggacaucaaauaguaucguuguguucugugggacuagcggcaccuauggaacaggcuccuggcccgauggggcagacauuaaccugaugccuauauga

SEQ ID NO: 148329 - RNA, 1410 nt, Artificial Sequence; identical to SEQ ID NO: 148328
  derived and/or modified sequence opt3 from neuraminidase__InfluenzaA__EPI465399

SEQ ID NO: 148330 - RNA, 1410 nt, Artificial Sequence; identical to SEQ ID NO: 148328
  derived and/or modified sequence opt3 from neuraminidase__InfluenzaA__EPI328899

SEQ ID NO: 148331 - RNA, 1410 nt, Artificial Sequence; identical to SEQ ID NO: 148328
  derived and/or modified sequence opt3 from neuraminidase__InfluenzaA__EPI328901

SEQ ID NO: 148332 - RNA, 1410 nt, Artificial Sequence
  derived and/or modified sequence opt3 from neuraminidase__InfluenzaA__EPI574645
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucugggugacccgcgagccuuaugucucgugcgacccagauaaguguuaccaauucgcgcuggggcagggaacgacucuaaauaacggccauucaaauaacaccgugcgagaccguacacccuauagaacucuccugaugaaugaacuugguguuccuuuucaccuggggaccaaacaggugugcauugcuuggagcaguuccucuugucaugauggaaaggccugguugcacgucugcaucacaggcgacgauaagaacgcaaccgccagcuucaucuacaauggcaggcucguggacuccguaguuucauggaguaaagauauucugcggacgcaggagagcgaaugugugugcauaaacgggacuuguacagucgugaugaccgacggaucugcuuccgguaaggcagauacuaaaauccuguuuauugaggagggcaagaucauacauacaucaacccucagcgggagugcccaacacguggaagagugcucuugcuauccacgcuacccgggagucagauguguuugcagggacaacuggaagggcuccaaucggcccauuguggauaucaacaucaaagaccacagcauuguaucgucuuacguguguuccgguuuagucggggacacgccucgcaagaaugauucaaguagcuccucucauugccuggacccaaacaaugaagagggaggccacggcgugaaagggugggcuuucgaugacggaaacgauguuuggaugggucgaaccaucaaugaaacaagcagacuuggcuaugagacuuuuaaggugauugagggguggucaaaccccaaaaguaaguugcagauaaauaggcaggucaucguggaccggggagaucguuccggcuacagcgguauuuucucuguagaagggaaaucauguaucaaccgcugcuuuuauguugagcugaucagaggcaggaaggaagagaaugaagugcuauggaccaguaacagcauugucguguucuguggaacauccggcacuuacgggaccggaucuuggccugacggugccgaucucaaucugaugccaauauga

SEQ ID NO: 148333 - RNA, 1410 nt, Artificial Sequence
  derived and/or modified sequence opt3 from neuraminidase__InfluenzaA__EPI563214
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacaguguagcauaacaggguucgcacccuuuuccaaagacaacucuauucgguuaucggccggaggugauaucuggguaacccgcgagccuuaugugucaugcgacccagauaaguguuaccaauucgcgcugggccaggggacgacucuaaauaacguccauagcaauaacaccgugcgagaccguacacccuauagaacucuccugaugaaugaacuuggaguuccuuuucaccugggcaccaaacaggugugcauugcuuggaguuccucuagcugucaugaugguaaggccugguugcacgucugcaucacaggggacgauaagaacgcaaccgccuccuucaucuacaauggaaggcucguggacucaguaguuaguuggagcaaagauauucugcggacgcaggagucugaaugugugugcauaaacggcacuuguacagucgugaugaccgacggcuccgcuucagggaaggcagauacuaaaauccuguuuauugaggagggaaagaucguguauacaagcaagcucagugguucugcccaacaugucgaagagugcuccugcuacccacgcuacccgggcguuagaugugugugcagggacaacuggaaagggagcaaucggcccauaguagauauuaacaucaaggaccacucgaucgugucuuccuaugucuguucaggauuagugggcgacaccccucgcaaaaaugauaguagcuccucuagccacugccuggacccaaacaaugaagagggugggcauggaguuaagggcugggcuuucgaugacggcaacgauguguggauggggcgaacgauuaaugaaaccucaagacuuggauacgagacauuuaaagucguggaggguuggaguaaccccaaguccaaauugcagaucaauaggcagguaauuguugaccggggcgaucguagcggguauucuggaauauucucaguggaaggcaagaguuguaucaaccgcugcuuuuacgucgagcugauuagagguaggaaggaagagacugaagugcuauggaccagcaauuccaucgucguguucugugggacaucuggcacuuauggaaccggcucguggccugacggggccgaucucaaccugaugccaaucuga

SEQ ID NO: 148334 - RNA, 1410 nt, Artificial Sequence; identical to SEQ ID NO: 148333
  derived and/or modified sequence opt3 from neuraminidase__InfluenzaA__EPI553998

SEQ ID NO: 148335 - RNA, 1410 nt, Artificial Sequence
  derived and/or modified sequence opt3 from neuraminidase__InfluenzaA__EPI551568
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacaguguagcauaacaggguucgcacccuuuuccaaagacaacucuauucgguuaucggccggaggugauaucuggguaacccgcgagccuuaugugucaugcgacccagauaaguguuaccaauucgcgcugggccaggggacgacucuaaauaacguccauagcaauaacauugugcgagaccguacccccuauagaacacuccugaugaaugaacuuggaguuccuuuucaccugggcacuaaacaggugugcaucgcuuggaguuccucuagcugucaugaugguaaggccugguugcacgucugcaucaccggggacgauaagaacgcaacagccuccuucauuuacaauggaaggcucguggacucaguaguuaguuggagcaaagauauacugcggacccaggagucugaaugugugugcaucaacggcacguguacugucgugaugacagacggcuccgcuucagggaaggcagauaccaaaauucuguuuaucgaggagggaaagauaguguauacuagcaagcucagugguucugcccaacaugucgaagagugcuccugcuacccacgcuacccgggcguuagaugugugugcagggacaacuggaaagggagcaaucggcccauuguagauaucaacaucaaggaccacucgauugugucuuccuaugucuguucaggauuagugggcgacacaccucgcaaaaaugauaguagcuccucuagccacugccuggacccaaacaaugaagagggugggcauggaguuaagggcugggcuuucgaugacggcaacgauguguggauggggcgaaccaucaaugaaacgucaagacuuggauacgagaccuuuaaagucguggaggguuggaguaaccccaaguccaaauugcagauuaauaggcagguaauaguugaccggggcgaucguagcggguauucuggaaucuucucaguggaaggcaagaguuguauuaaccgcugcuuuuacgucgagcugaucagagguaggaaggaagagacagaagugcuauggacuagcaauuccaucgucguguucugugggaccucuggcacauauggaacuggcucguggccugacggggccgaucucaaccugaugccaauuuga

SEQ ID NO: 148336 - RNA, 1410 nt, Artificial Sequence
  derived and/or modified sequence opt3 from neuraminidase__InfluenzaA__EPI629737
augaaccccaaucagaagaucauugccauaggcagcgugucccugaccaucucuacaauuugcuucuuuaugcaaaucgcuauucucaucacuacggucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaaccugcagaguacaggaauuggaguaagccacaguguagcauaacuggguucgcccccuuuuccaaagacaacucuauucgguuaucggcgggaggugauaucuggguaacacgcgagccuuaugugucaugcgacccagauaaguguuaccaauucgcucugggccaggggaccacgcuaaauaacguccauagcaauaacacugugcgagaccguacccccuauagaacacuccugaugaaugaacuuggaguuccuuuucaccugggcacuaaacaggugugcauugccuggaguuccucuagcugucaugaugguaaggcaugguugcacgucugcaucaccggggacgauaagaacgccacagcuuccuucaucuacaauggaaggcucguggacucaguaguuaguuggagcaaagauauucugcggacccaggagucugaaugugugugcauaaacggcacguguacugucgugaugacagacggcuccgcaucagggaaggccgauaccaaaauccuguuuauugaggagggaaagaucguguauacuagcaagcucagugguucugcucaacaugucgaagagugcuccugcuacccacgcuacccgggcguuagaugugugugcagggacaacuggaaagggagcaaucggcccauaguagauauuaacaucaaggaccacucgaucgugucuuccuaugucuguucaggauuagugggcgacacaccucgcaaaaaugauaguagcuccucuagccacugccuggacccaaacaaugaagagggugggcauggaguuaagggcugggccuucgaugacggcaacgauguguggauggggcgaaccauuaaugaaacgucaagacuuggauacgagaccuuuaaagucguggaggguuggaguaaccccaaguccaaauugcagaucaauaggcagguaauuguugaccggggcgaucguagcggguauucuggaauauucucaguggaaggcaagaguuguaucaaccgcugcuuuuacgucgagcugauuagagguaggaaggaagagacagaagugcuauggacuagcaauuccaucgucguguucugugggaccucuggcacauauggaacuggcucguggccugacggggcggaucucaaccugaugccaaucuga

SEQ ID NO: 148337 - RNA, 1410 nt, Artificial Sequence; identical to SEQ ID NO: 148333
  derived and/or modified sequence opt3 from neuraminidase__InfluenzaA__EPI631886

SEQ ID NO: 148338 - RNA, 1410 nt, Artificial Sequence; identical to SEQ ID NO: 148333
  derived and/or modified sequence opt3 from neuraminidase__InfluenzaA__EPI577025

SEQ ID NO: 148339 - RNA, 1410 nt, Artificial Sequence; identical to SEQ ID NO: 145887
  derived and/or modified sequence opt3 from neuraminidase__InfluenzaA__EPI404926

SEQ ID NO: 148340 - RNA, 1410 nt, Artificial Sequence; identical to SEQ ID NO: 145887
  derived and/or modified sequence opt3 from neuraminidase__InfluenzaA__EPI492687

SEQ ID NO: 148341 - RNA, 1410 nt, Artificial Sequence
  derived and/or modified sequence opt3 from neuraminidase__InfluenzaA__EPI530648
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacgauguguggaugggacgaaccauuaaugagacaagcagacuugguuaugagacuuuuaaggucaucgagggcuggucaaaccccaaaaguaaguugcagaccaauaggcaagugauuguagaccguggggaucgguccggauacagcggcauauucucuguugaagguaaaucauguaucaaccgcugcuuuuauguggagcugauuagagggaggaaggaagagacagaaguccuauggaccaguaauagcaucguggucuucuguggcacuuccggaacauacggcaccgggucuuggccugacggagccgaucucaaccugaugccaaucuga

SEQ ID NO: 148342 - RNA, 1410 nt, Artificial Sequence; identical to SEQ ID NO: 148323
  derived and/or modified sequence opt3 from neuraminidase__InfluenzaA__EPI684314

SEQ ID NO: 148343 - RNA, 1410 nt, Artificial Sequence
  derived and/or modified sequence opt3 from neuraminidase__InfluenzaA__EPI614459
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaagccugcugaauacaggaauuggaguaaaccacagugugggauaacaggauucgcacccuuuagcaaggacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugagcuuggcguuccuuuucaccuggguaccaaacaggugugcauugcuuggagcaguuccucuugucaugaugggaaggccugguugcacgucugcaucacaggagacgauaaaaacgcaaccgccagcuucaucuacaauggcaggcucguggacuccguaguuucauggaguaaggauauucugcggacgcaggaaagcgagugugugugcauaaacggcacuuguacagucgugaugaccgacgggucugcuuccggaaaagcagauacuaagauccuguuuauugaagaggguaagaucgugcauacaucaacccucagcggcagugcccaacacgucgaggaaugcucuugcuauccacgcuacccggggguuagaugugugugcagggacaacuggaaaggauccaaucggcccauaguagauauuaacaucaaggaccacagcaucgugucgucuuacgucuguuccggcuuagugggugacacgccucgcaaaaaugauucaaguagcuccucucauugccuggacccaaacaaugaggaagggggacacggcguuaagggcugggcuuucgaugacgggaacgauguguggaugggacgaaccauuaaugagacaagcagacuugguuaugaaacuuuuaaagucaucgagggcuggucaaaccccaagaguaaauugcagaccaauaggcaagugauuguagaccguggggaucgguccggauacagcggcauauucucuguugaggguaagucauguaucaaccgcugcuuuuauguggaacugauuagagggaggaaggaggaaacagagguccuauggaccaguaauagcaucguggucuucuguggcacuuccggaacauacggcaccgggucuuggccugacggagccgaucucaaccugaugccaaucuga

SEQ ID NO: 148344 - RNA, 1410 nt, Artificial Sequence; identical to SEQ ID NO: 148343
  derived and/or modified sequence opt3 from neuraminidase__InfluenzaA__EPI541466

SEQ ID NO: 148345 - RNA, 1410 nt, Artificial Sequence; identical to SEQ ID NO: 148343
  derived and/or modified sequence opt3 from neuraminidase__InfluenzaA__EPI696968

SEQ ID NO: 148346 - RNA, 1410 nt, Artificial Sequence; identical to SEQ ID NO: 148343
  derived and/or modified sequence opt3 from neuraminidase__InfluenzaA__EPI674598

SEQ ID NO: 148347 - RNA, 1410 nt, Artificial Sequence; identical to SEQ ID NO: 148341
  derived and/or modified sequence opt3 from neuraminidase__InfluenzaA__EPI530678

SEQ ID NO: 148348 - RNA, 1410 nt, Artificial Sequence
  derived and/or modified sequence opt3 from neuraminidase__InfluenzaA__EPI530680
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcgagaccguacacccuauagaacucuccugaugaaugaacuuggcguuccuuuucaccuggguaccaaacaggugugcauugcuuggagcaguuccucuugucaugaugggaaggccugguugcacgucugcaucacaggagacgauaagaacgcaaccgccagcuucaucuacaauggcaggcucguggacuccguaguuucauggaguaaagauauucugcggacgcaggagagcgaaugugugugcauaaacggcacuuguacagucgugaugaccgacgggucugcuuccggaaaggcagauacuaaaauccuguuuauugaggaggguaagaucgugcauacaucaacccucagcggcagugcccaacacgucgaagagugcucuugcuauccacgcuacccggggguuagaugugugugcagggacaacuggaagggauccaaucggcccauaguagauauuaacaucaaagaccacagcaucgugucgucuuacgucuguuccggcuuagugggugacacgccucgcaagaaugauucaaguagcuccucucauugccuggacccaaacaaugaagaagggggacacggcguuaaaggcugggcuuucgaugacgggaacggaguguggaugggucgaaccauuaaugagacaagcagacuuggcuaugagacuuuuaaggucaucgagggguggucaaaccccaaaaguaaguugcagaccaauaggcaagugauuguagaucggggagaccguuccggcuacagcgguauauucucuguugaagggaaaucauguaucaaccgcugcuuuuauguggagcugauuagaggcaggaaggaagagacagaaguccuauggaccaguaauagcaucguggucuucuguggaacuuccggcacauacgggaccggaucuuggccugauggugccgaccucaaccugaugccaaucuga

SEQ ID NO: 148349 - RNA, 1410 nt, Artificial Sequence; identical to SEQ ID NO: 136054
  derived and/or modified sequence opt3 from neuraminidase__InfluenzaA__EPI7603

SEQ ID NO: 148350 - RNA, 1410 nt, Artificial Sequence; identical to SEQ ID NO: 148341
  derived and/or modified sequence opt3 from neuraminidase__InfluenzaA__EPI814527

SEQ ID NO: 148351 - RNA, 1410 nt, Artificial Sequence; identical to SEQ ID NO: 148341
  derived and/or modified sequence opt3 from neuraminidase__InfluenzaA__EPI674737

SEQ ID NO: 148352 - RNA, 1410 nt, Artificial Sequence; identical to SEQ ID NO: 148341
  derived and/or modified sequence opt3 from neuraminidase__InfluenzaA__EPI614443

SEQ ID NO: 148353 - RNA, 1410 nt, Artificial Sequence; identical to SEQ ID NO: 148341
  derived and/or modified sequence opt3 from neuraminidase__InfluenzaA__EPI551812

SEQ ID NO: 148354 - RNA, 1410 nt, Artificial Sequence; identical to SEQ ID NO: 148341
  derived and/or modified sequence opt3 from neuraminidase__InfluenzaA__EPI696961

SEQ ID NO: 148355 - RNA, 1410 nt, Artificial Sequence; identical to SEQ ID NO: 148341
  derived and/or modified sequence opt3 from neuraminidase__InfluenzaA__EPI740789

SEQ ID NO: 148356 - RNA, 1410 nt, Artificial Sequence
  derived and/or modified sequence opt3 from neuraminidase__InfluenzaA__EPI377498
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugggauaacaggauucgcacccuuuagcaaagacaacuccauucgguuaucugccgguggcgauaucuggguaacccgcgagccuuaugugucgugcgacccagauaaguguuaccaauucgcgcuggggcagggaacgacucuaaauaacguccauucaaauaacaccgugcacgaccgaacacccuaucguacucuccugaugaaugaacuuggcguuccuuuucaucuggguaccaaacaggugugcauugcuuggagcaguuccucuugucacgaugggaaggccugguugcaugucugcaucacaggagacgauaagaacgcaaccgccagcuucaucuacaauggcagacucguggacuccguaguuucauggaguaaagagauucugaggacgcaggaaagcgagugugugugcauaaacggcacuuguacagucgugaugaccgaugggucugcuuccggaaaggcagacacuaaaauccuguuuauugaggaagguaagaucgugcacacaucaacccucagcggcagugcccaacacgucgaggaaugcucuugcuauccacgguacccggggguucgcugugugugcagagauaacuggaagggauccaauaggcccauaguagacauuaacaucaaagaucauagcaucgugucgucuuacgucuguuccggcuuagugggugacacgccucggaagaaugacucaaguagcuccucucacugccuggauccaaacaaugaggaagggggacauggcguuaaaggcugggcuuucgacgaugggaacgacguguggaugggacgcaccauuaaugagacaagccgacuugguuaugagacuuuuaaggucaucgaaggcuggucaaaccccaaaaguaaguugcagauuaauagacaggugauaguagauaggggagaccgguccggguacagcggcaucuucucuguugaggguaaaucauguauuaaccguugcuuuuauguggaacugauccgcgggagaaaggaggaaaccgagguccuauggacaaguaauagcaucguggucuucuguggcacuuccggaaccuacggcacagggucuuggccugauggagccgaccucaaccugaugccaauuuga

SEQ ID NO: 148357 - RNA, 1410 nt, Artificial Sequence; identical to SEQ ID NO: 148356
  derived and/or modified sequence opt3 from neuraminidase__InfluenzaA__EPI377498

SEQ ID NO: 148358 - RNA, 1410 nt, Artificial Sequence; identical to SEQ ID NO: 148356
  derived and/or modified sequence opt3 from neuraminidase__InfluenzaA__EPI391246

SEQ ID NO: 148359 - RNA, 1410 nt, Artificial Sequence; identical to SEQ ID NO: 148356
  derived and/or modified sequence opt3 from neuraminidase__InfluenzaA__EPI407122

SEQ ID NO: 148360 - RNA, 1410 nt, Artificial Sequence; identical to SEQ ID NO: 148356
  derived and/or modified sequence opt3 from neuraminidase__InfluenzaA__EPI407125

SEQ ID NO: 148361 - RNA, 1410 nt, Artificial Sequence; identical to SEQ ID NO: 148323
  derived and/or modified sequence opt3 from neuraminidase__InfluenzaA__EPI562038

SEQ ID NO: 148362 - RNA, 1410 nt, Artificial Sequence; identical to SEQ ID NO: 148323
  derived and/or modified sequence opt3 from neuraminidase__InfluenzaA__EPI562038

SEQ ID NO: 148363 - RNA, 1410 nt, Artificial Sequence; identical to SEQ ID NO: 144633
  derived and/or modified sequence opt3 from neuraminidase__InfluenzaA__EU716525

SEQ ID NO: 148364 - RNA, 1350 nt, Artificial Sequence
  derived and/or modified sequence opt3 from neuraminidase__InfluenzaA__EPI232422
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucaccccauagaacacugaugaguugcccugugggagaggccccaagccccuauaauucuagguuugaauccgucgcauggucagccagcgcuugucacgacggcaccaguuggcuuacuaucggcauuucugggccugauaacggagcaguggccguacugaaguacaaugguaucaucacagacaccauuaaguccuggcggaacaauauauugcgcacgcaggagagcgagugcgcuuguguuaacggcucgugcuucacugugaugaccgaugggccaucuuccggacaggccucauauaaaaucuuuaagauggaaaaaggcaaggucgugaaaaguguggagcucgacgcgcccaauuaccauuaugaagaguguagcugcuacccugaugccggugagauuacaugugucugcagagacaacuggcacggguccaacaggccauggguuucuuucaaucagaaccuggaauaucaaaucggauacauaugcagcggcguguuuggcgauaauccgcggcccaacgacgggacuggaucaugugguccuguaaguccaaauggcgcauacggggugaagggauucuccuuuaaguauggcaacggugucuggauugggcgcaccaaaagcacaaauucucgaucaggcuucgagaugaucugggaucccaacggauggaccggcacggacaguagcuuuuccgugaagcaggacaucguugcuauuacugauuggucuggguacucgggauccuucgugcagcacccugaacugacaggucucgacugcaucagaccauguuucugggucgaguuaauuaggggccggcccaaagaauccaccauauggacuucagggaguucuaucagcuuuugcggagugaauagcgauacaguaucauggagcuggccggacggcgccgagcugccuuucaccauugauaaguga

SEQ ID NO: 148365 - RNA, 1350 nt, Artificial Sequence; identical to SEQ ID NO: 148200
  derived and/or modified sequence opt3 from neuraminidase__InfluenzaA__EPI227593

SEQ ID NO: 148366 - RNA, 1350 nt, Artificial Sequence
  derived and/or modified sequence opt3 from neuraminidase__InfluenzaA__EPI435658
augaaccccaaucagaagaucgugaccauuggcagcauaugcauggucaucgggauuaucucccugaugcuccaaauuggaaacaucauaucuaucuggguuucacacaguauucagacagguaaucagcaucagacugagccuaucagaaacacgaauuuccuuaccgaaaacgccguggcuagcguaacacuggcaggcaauuccucuuuguguccaauuagggggugggccgugcacucgaaagacaacucaauccggauaggaagcaagggcgaugucuuugugauucgcgagccguucaucaguugcucccauuuagaaugucgaaccuuuuuccugacucaaggugcgcuacucaaugacaaacacucuaacgggacaguuaaggaucguagcccccauagaacccugauguccugcccuauuggagaggcuccaucacccuacaauaguagguuugaaagcguggccuggucugcauccgccugucacgacggcacuucauggcuuaucaucggcauuagcgggccugauaacggagcugucgcagugcugaaauauaaugguauaaucacagacaccauuaagaguuggcggaacaauaucuugcgcacgcaggagucugagugcgccuguguaaacggcuccugcuucacuguuaugaccgaugggccaagcaacggacaggcuucguacaagauauuuaaaauugaaaagggcaaaguggucaagucuguggagcucaaugcccccaacuaucacuacgaagaguguuccugcuauccugacgcgggugagaucaucugugugugcagagauaauuggcaugggucaaacaggccaugggucaguuucaaucagaaccuggaauaccaaauuggauauaucugcagcggcguuuuuggcgacaauccgcggcccaacgaugggacaggauccugugguccugugucuccaaauggcgcauacgggguaaaaggauucagcuuuaaguacggcaacgguguguggauugggcgcacuaagucaacccacagucgauccggcuucgagaugauaugggaccccaauggauggacaggcaccgauagcgaauuuucuaugaaacaggacaucgucgccauuacggacuggucaggguauagugguagcuucgugcagcauccugagcugacuggacucgauugcaucagaccauguuucuggguugaauuaaucaggggccggcccaaggaguccacaauuuggaccucugggucgagcauauccuuuugcggagugaacucagacacugucaguuggucuuggccggauggcgcugagcugccuuucacaaucgacaaauga

SEQ ID NO: 148367 - RNA, 1350 nt, Artificial Sequence; identical to SEQ ID NO: 148366
  derived and/or modified sequence opt3 from neuraminidase__InfluenzaA__EPI492513

SEQ ID NO: 148368 - RNA, 1350 nt, Artificial Sequence; identical to SEQ ID NO: 141713
  derived and/or modified sequence opt3 from neuraminidase__InfluenzaA__EPI165066

SEQ ID NO: 148369 - RNA, 1350 nt, Artificial Sequence
  derived and/or modified sequence opt3 from neuraminidase__InfluenzaA__EPI531308
augaaccccaaucagaagaucauuaccauaggcagcaucugcauggugacaggggucguuucccugaugcuccaagugggaaacaugauuucuaucuggauuucacacaguauccauacugguaaucagcaccaggccgagccuauaagcaacacgaauuuccauaccgaaaaagcuguaguguccgcaaaacuugccggcaacucuucgcuguguccaaucaaugggugggcggucuacucaaaggacaacagcauuagaaucggaaguaagggcgauguguuuguuauuagggagccguucaucuccugcucucacuuggaaugucggacauuuuucuuaacucagggugcucugcuaaaugacaaacauagcaacgggaccgccaaggaucgcucaccccaccgaacacucauguccugcccugugggagaggcaccaagucccuauaauagccguuuugaaucugucgccugguccgcuucagcaugucacgacggcaccagcuggcugacuauaggcauuagugggccugauaacggagccguggcuguacuuaaguacaaugguaucauuacagacaccaucaaaucuuggagaaacaauguucugaggacgcaagaguccgagugcgccugugugaacggcuauugcuucacugucaugaccgaugggccaagcaacggacaggcgucgcauaagaucuuuaaaauggaaaagggcaaagugauuaagucuguggaguuggacgcacccaauuaccacuaugaagaguguuccugcuacccugaugccggugagauaacaugugucugccgggacaacuggcaugggucaaaucgcccauggaucaguuucaaccagaaucucgaauaucagauuggauacaucugcagcggcguuuuuggcgauaacccgagacccaaugacgggaagggauccugugguccugugucuagcaacggcgcuuacgggguaaaaggauucucauuuaaguauggcaaugguguguggauagggaggacuaaaaguaccaacucccggagcggcuucgagaugauuugggauccaaauggauggacagaaaccgacucuucauuuagugucaagcaagacaucguggccaucacggauuggagcggcuacuccgggucuuucguucagcaccccgagcugacuggacuggacugcauucgcccuuguuucuggguggaacucauccgagguagaccaaaagagggcacaauuuggaccucggggagcuccauaucauuuugcggagucaguggcgauacuguggguuggucuuggcccgacggggcagaguuaccguucacaaucgauaaguga

SEQ ID NO: 148370 - RNA, 1350 nt, Artificial Sequence
  derived and/or modified sequence opt3 from neuraminidase__InfluenzaA__EPI433308
augaaccccaaucagaagaucauuaccauaggcagcaucugcauggugauugggaucgucucccugaugcuccaaauuggaaaccuuaucucuauauggguuucacacaguauccagagagguaaucugaaccagguggagccuauuagcaauacauccuucccaacugaaaaagccguagcuucugugacguuggcaggcaacucgucauuauguccgaucagggggugggccguccauagcaaggacaauaguauucggaucggauccaaaggcgauguguuuguuauacgcgagcccuucauuucuugcagccaccuggaaugucgaaccuuuuuccuaacacagggugcgcuccugaacgacaagcauuccaaugggacugugaaagaucguucaccucacagaacccuuaugaguugcccagucggagaggcucccagcccuuacaacucuagguuugaauccguggccuggucagcaagcgccugucaugacggcacaaguuggcugaccaucggcauuucugggccagauaauggagcuguagcaguugugaaguauaacgguaucaucacugacacaauuaaguccuggggcaauaacauauugcggacccaagagagcgagugcgccugugucaaugggucgugcuucacggugaugacugauggacccucuaacggccaggcuuccuacaaaaucuuuaagauggaaaaagguaaggugauuaaaucagucgagcucgacgccccuaacuaucacuacgaagaguguaguugcuauccagaugcgggggagaucaccuguguuugccgcgacaauuggcacggaagcaacagaccguggguguccuucaaucagaaccuggaauaccagauaggcuauauuugcucuggcguauuuggggauaaucccaggccuaacgacggaacagguagcuguggcccagugucacccaauggggcauacggagucaagggcuucaguuuuaaguacgguaacgggguguggaucggccggacuaaauccccuaauagccgcucuggauucgagaugaucugggauccaaacggcuggucagaaaccgacaguagcuuuuccguuaagcaagacauucuggccgugacagauuggucuggguauucggguagcuucguccagcaucccgagcucaccggauuagacugcauccgaccguguuucuggguggaacugauuagaggcaggccugaggaguccacgauauggacuucagggaguucuaucagcuuuugcggaguaaauuccgauacaguuucauggagcuggcccgacggcgcugaacuuccauucaccauugauaaauga

SEQ ID NO: 148371 - RNA, 1350 nt, Artificial Sequence
  derived and/or modified sequence opt3 from neuraminidase__InfluenzaA__EPI114974
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucaccccauagaacacugaugaguugcccugugggagaggccccaagccccuauaauucuagguuugaauccgucgcauggucagccagcgcuugucacgacggcaccaguuggcuuacuaucggcauuucugggccugauaacggagcaguggccguacugaaguacaaugguaucaucacagacaccauuaaguccuggcggaacaauauauugcgcacgcaggagagcgagugcgcuuguguuaacggcucgugcuucacugugaugaccgaugggccaucuaauggacaggccuccuauaaaaucuuuaagauggaaaaaggcaaggucgugaaaucaauugagcucgacgcgcccaacuaccauuaugaagaguguaguugcuacccugaugccggugagaucacaugugugugcagagacaacuggcacgggagcaauaggccaugggucuccuucaaccagaaucuggaauaucaaauaggauacauuugcucuggcguuuuuggcgauaacccgcggcccaaugacgggacuggaagcugugguccugugucaccaaacggcgcauacgggguaaagggauucaguuuuaaguauggcaaugguguguggaucgggcgcaccaaauccacaaacagccgaucuggcuucgagaugaucugggaucccaauggauggaccggcacggacucaaguuuuagcgucaagcaggacauuguggcuaucacugauugguccggguacucuggaucguucguucagcacccugaacugacaggucucgacugcauuagaccauguuucuggguggaguuaauaaggggccggcccaaagaaagcaccaucuggacuuccgggucaaguauuucuuuuugcggagucaacagcgauacaguguccuggucauggccggacggcgccgagcugccuuucaccaucgauaaguga

SEQ ID NO: 148372 - RNA, 1350 nt, Artificial Sequence
  derived and/or modified sequence opt3 from neuraminidase__InfluenzaA__EPI622495
augaaccccaaucagaagaucaccacaauuggcagcauaugcauggugaucgggauugucucccugaugcuccaaaucggaaacaugguuucuauuugggugucacacaguauccagacuagaaaucagaggcaggccgagccuauaagcaacacgcggucccuuaccgaaaaagcuguagcaucugugacacuggccgguaauucgucauuguguccaaucagcggcugggcggucuacaguaaggacaacuccauucgcaucgggucuaaaggagauguguucguuauucgagagccguuuaucagcugcucccauuuagaaugucguacuuucuuucugacccaaggcgcucuacucaaugacaagcacucaaacgguacagugaaagauagaaguccccauaggacccugaugagcugcccugucggggaggccccaucucccuauaauucccgguucgaaucaguggcauggagcgccagugcuugucacgacggaacuucuuggcuuacaauaggcauuuccggcccugauaacggggcaguagccguugugaaguacaauggaaucauuaccgacacgaucaagagcuggcgcaacaauauccugagaacucaggagucggagugcgucugugugaacgguucuugcuuuaccgugaugacagauggcccauccaauaaacaggcuucauauaagauuuucaaaauggaaaaggggaaagucguuaagaguauagaguuggacgcccccaacuaccauuaugaagaguguagcugcuacccugaugcgggagagaucacuugugugugcagggacaacuggcacggcuccaaucggccauggcucucuuuuaaccagaaucuggaauaucaaauugguuacaucugcagcgggguauucggagauaacccgcgccccaaugacggcaccggcucaugugggccugugaguuccaacggagcauacggugucaagggcuuuagcuucaaauaugggaauggaguguggauaggccgaacaaagucuaccaacucaagaagugguuuugagaugauuugggauccaaauggguggacgggcacugacagcuccuucucuaugaaacaggacaucguugccaucacagauuggucgggauacagcggcuccuuugugcagcaccccgaacugaccgggcucgacugcauuaggccuuguuucugggucgaguuagugcggggacguccaaaggaagguacuaucuggacaucaggcaguucuauuagcuucugcgggguaaacuccgauaccguuucauggagcuggcccgacggagcugagcugccguuuacgauagauaaauga

SEQ ID NO: 148373 - RNA, 1350 nt, Artificial Sequence
  derived and/or modified sequence opt3 from neuraminidase__InfluenzaA__EPI349847
augaaccccaaucagaagaucaccacaauuggcagcauaugcauggugaucgggauugucucccugaugcuccaaaucggaaacaugguuucuauuugggugucacacaguauccagacuagaaaucagaggcaggccgagccuauaagcaacacgcggucccuuaccgaaaaagcuguagcaucugugacacuggccgguaauucgucauuguguccaaucagcggcugggcggucuacaguaaggacaacuccauucgcaucgggucuaaaggagauguguucguuauucgagagccguuuaucagcugcucccauuuagaaugucguacuuucuuucugacccaaggcgcucuacucaaugacaagcacucaaacgguacagugaaagauagaaguccccauaggacccugaugagcugcccugucggggaggccccaucucccuauaauucccgguucgaaucaguggcauggagcgccagugcuugucacgacggaacuucuuggcuuacaauaggcauuuccggcccugauaacggggcaguagccguugugaaguacaauggaaucauuaccgacacgaucaagagcuggcgcaacaauauccugagaacucaggagucggagugcgucugugugaacgguucuugcuuuaccgugaugacagauggcccauccaauaaacaggcuucauauaagauuuucaaaauggaaaaggggaaagucguuaagaguauagaguuggacgcccccaacuaccauuaugaagaguguagcugcuacccugaugcgggagagaucacuugugugugcagggacaacuggcacggcuccaaucggccauggcucucuuuuaaccagaaucuggaauaucaaauugguuacaucugcagcgggguauucggagauaacccgcgccccaaugacggcaccggcucaugugggccugugagucacaacggagcauacggugucaagggcuuuuccuucaaauaugggaauggaguguggauaggccgaacaaagagcaccaacucuagaucagguuuugagaugauuugggauccaaauggguggacgggcacugacaguagcuucuccaugaaacaggacaucguugccaucacagauuggucuggauacucgggcagcuuugugcagcaucccgaacugaccgggcucgacugcauuaggccuuguuucugggucgaguuagugcggggacguccaaaggaagguacuaucuggacauccggcucaaguauuucuuucugcgggguaaacagcgauaccguuuccuggucauggcccgacggagcugagcugccguuuacgauagauaaauga

SEQ ID NO: 148374 - RNA, 1350 nt, Artificial Sequence
  derived and/or modified sequence opt3 from neuraminidase__InfluenzaA__EPI174804
augaaccccaaucagaagaucauuaccauaggcagcaucugcauggugauugggaucgucucccugaugcuccaaauuggaaacaugguuucuaucugggugucacacaguauacagacaagaaaucagaggcaggccgagccuaucagcaacacuaaaucccuuacggaaaaggcuguagcaucugugacccuggccgguaauucgucauuguguccaauuagcggcugggcggucuacaguaaagacaacuccauccggauugggucuaagggagauguguucguuauccgcgagccguuuauaagcugcucccauuuagaaugucgaacauucuuucugacucaaggcgcucuacucaaugacaaacacucaaacgguaccauuaaggaucguaguccccauagaacacugaugagcugcccugugggggaggccccaucucccuauaauuccagguucgaaucagucgcauggagcgccagugcuugucacgacggaaccucuuggcuuacuaucggcauuuccggcccugauaacggggcaguggccguacugaaguacaauggaaucaucacagacaccauuaaaagcuggcggaacaauauauugcgcacgcaggagucggagugcgcuuguguuaacgguucuugcuuugccgugaugacugauggcccauccaauagacaggcgucauauaagaucuucaaaauggaaaaggggaaagucgugaagaguauugagcucgacgcacccaacuaccauuaugaagaguguagcugcuacccugaugccggagagaucaccugugugugcagggacaacuggcacggcuccaaucggccauggcugucuuuuaaccagaaucuggaauaucaaauagguuacauuugcagcggggucuucggagauaacccgcgccccaaugacggcacaggcucaugugggccuguuaguuccaacggagcuuacggugugaagggcuuuagcuucaaauaugggaauggaguauggaucggccgaacuaagucuaccaacucaagaagugguuuugagaugaucugggauccaaauggguggacagaaaccgacagcuccuucucuaugaaacaggacauuguggccaucacggauuggucgggcuacagcggauccuuuguccagcaccccgagcucacuggcuuagacugcauuaggccuuguuucuggguggaacugguucgggggcguccaaaggagucaacaauauggaccaguggaucuagcaucuccuucugcggugugaacucagauacugucagcuggucuuggcccgacggcgcagagcuuccguuuacaauugauaaauga

SEQ ID NO: 148375 - RNA, 1350 nt, Artificial Sequence
  derived and/or modified sequence opt3 from neuraminidase__InfluenzaA__EPI492441
augaaccccaaucagaagaucauggccauuggcagcgugugcauggucauagggaucguuucccugaugcuccaaauuggaaacaccaucucuauuugggugucacacaguuuccagacaagaguacagcaucaggcugagccuaucaggaauacuaacuuucuuacggaaaaugcaguggccagcgucacccuggcggguaacuccucuuuguguccaauacggggcugggcugugcacucgaaagacaauucaauccgcauugggagcaagggagauguuuucgugauccgagagccguuuauuaguugcucccauuuagaaugucguacauucuuucugacucaaggcgcccuacucaacgacaaacacucuaauagaaccgucaaggauaggagcccccaucggacacugauguccugcccugugggugagguaccaucacccuacaacagucgcuucgaaagcguugcauggucugccuccgcuugucacgacgggaccucauggcuuacuaucggaauaagcggcccugauaauggcgcaguggccguccugaaauauaacgggauuaucacagacaccauuaagaguuggagaaauaacaucuugaggacgcaggagucugagugcgcuugugugaauggauuuugcuucacugugaugaccgaugguccauccaacggccaggccagcuacaagaucuuuaaaaugaagaaagggaaggucguuaaaucgguggaacucaacgcgcccaauuaucacuacgaggaauguucuugcuauccugacgcaggagagauuauguguguaugccgggauaacuggcauggcuccaaucgcccaugggugucauucaaccagaaucuggaguaccaaauagguuauaucugcaguggggucuuuggagacaacccgcgacccaaugauggcacaggcagcugugggccuguguccccaaacggagccuacgguauuaagggcuucucuuuuaaguacgggaauggaguuuggaucggcagaacuaaaagcaccaacucaaggagugguuucgaaauggugugggaccccaauggguggacagauaccgacuccgacuucagcauaaagcaggauauugucgcuaucacggacuggucuggcuauucaggaaguuuugugcagcacccugagcugacuggccucgauugcauccggccauguuucuggguagaauuaauucgugggcgccccaaagagagcacaaucuggaccuccggaucuucgauuagcuuuugcgguguuaacuccgaaacugugucauggaguuggccggacggcgccgagcugccuuucacaauagauaaguga

SEQ ID NO: 148376 - RNA, 1350 nt, Artificial Sequence; identical to SEQ ID NO: 148003
  derived and/or modified sequence opt3 from neuraminidase__InfluenzaA__EPI164142

SEQ ID NO: 148377 - RNA, 1350 nt, Artificial Sequence
  derived and/or modified sequence opt3 from neuraminidase__InfluenzaA__EPI827076
augaaccccaaucagaagaucgugaccauuggcagcauaugcauggucaucgggauuaucucccugaugcuccaaauuggaaacaucauaucuaucuggguuucacacaguauucagacagguaaucagcaucagacugagccuaucagaaacacgaauuuccuuaccgaaaacgccguggcuagcguaacacuggcaggcaauuccucuuuguguccaauuaaagggugggccgugcacucgaaggacaacucaaucaggauaggaagcaaaggcgaugucuuugugauucgggagccguucaucaguugcucccauuuagaaugucgcaccuuuuuccugacucaaggugcgcuacucaaugacaagcacucuaacgggacaguuaaagaucgaagcccccaucguacccugauguccugcccuauuggagaggcuccaucacccuacaauaguagauuugaaagcguggccuggucugcauccgccugucacgacggcacuucauggcuuaucaucggcauuagcgggccugauaacggagcugucgcagugcugaaguauaaugguauaaucacagacaccauuaagaguuggaggaacaauaucuugcggacgcaggagucugagugcgccuguguaaacggcuccugcuucgcuguuaugacugaugggccaagcaacggacaggccucguacaaaauauuuaagauugaaaaaggcaagguggucaaaucuguggagcucaaugcgcccaacuaucacuacgaagaguguuccugcuauccugacgccggugagaucaucugugugugccgcgauaauuggcaugggucaaacagaccaugggucaguuucaaucagaaccuggaauaccaaauuggauauaucugcagcggcguuuuuggcgacaauccgaggcccaacgaugggaccggauccugugguccugugucuagcaauggcgcauacgggguaaagggauucucauuuaaguacggcaacgguguguggauugggcggacaaaaaguacucacucccgcagcggcuucgagaugauaugggacccaaauggauggaccggcacagauucugaauuuucaaugaagcaggacaucgucgcuauuaccgacuggaguggguauagcggauccuucgugcagcaucccgagcugacgggucucgauugcauccgaccuuguuucuggguugaauuaaucagaggcaggccaaaagagucuacuauuuggacaucggggagcuccauaucauuuugcggagugaacagugacaccgucucuuggagcuggcccgauggcgccgagcugccguucacuaucgacaaguga

SEQ ID NO: 148378 - RNA, 1350 nt, Artificial Sequence; identical to SEQ ID NO: 138595
  derived and/or modified sequence opt3 from neuraminidase__InfluenzaA__EPI168491

SEQ ID NO: 148379 - RNA, 1350 nt, Artificial Sequence
  derived and/or modified sequence opt3 from neuraminidase__InfluenzaA__EPI827078
augaaccccaaucagaagaucauuaccauaggcagcaucugcauggugauugggaucgccucccugaugcuccaaauuggaaacaucauaucuaucuggauuucacacaguauccagacagguaaucagugucagaacgagagcauuuccaauacuaaauuccuugcugaaaaggcagucgccucuguuacgcuggcgggcaacucgucauugugcccugugagcgggugggcuguauacaguaaagacaauuccaucagaauaggaucuaagggcgauguguuugucauuagggagccauucaucagcuguucccauuuagaaugccggaccuuuuuccugacacaaggugcccuacucaacgacaaacacucaaaugggacugugaaggaucgcaguccgcaucgaacccugaugagcugucccguuggagaggcaccuucuccauauaacucccguuuugaaucaguggccuggagcgcuagugcaugccacgacggcacaucuuggcuuaccauuggcaucuccgggcccgauagcggagccgucgcugugcugaaguacaaugguaucauuacugacacaauaaaaucguggagaaacaauaucaugaggacccaggagucugagugugccugcguaaacggcuccuguuucacgauuaugacugaugggccuucaaguggacaggcgagcuauaagaucuuuaaaauggaaaagggcaaaguuauaaaguccguggaguuggacgcaccaaauuaccauuaugaagagugcucuuguuaccccgaugccggugagauuaccugcgucugccgggacaacuggcacgggagcaaccgcccuuggaucucauucaaucagaaccucgaauaucaaaucggauacauuuguaguggcguguuuggcgauaauccaagaccgaacgacgggacaggauccugcggucccguguucccuaauggcgcuuacggggucaagggauuuagcuucaaauauggcaacgguguuuggaucgggaggacuaagucuaccaauucacggaguggcuuugagaugauuugggauccaaacggauggacaggcaccgacagcuccuucucugugaaacaggacauaguagccaucacggaauggucgggguacagcggauccuucgugcagcaccccgagcugacuggucuggauuguauucgcccuugcuuuugggucgaacucauccgaggcagaccaaaggagucaacaaucuggaccagugggucuagcauuuccuucuguggagugaauggcgacacuguuucauggagcuggcccgauggugcagaguuaccguuuacaauagacaaauga

SEQ ID NO: 148380 - RNA, 1350 nt, Artificial Sequence
  derived and/or modified sequence opt3 from neuraminidase__InfluenzaA__EPI594521
augaaccccaaucagaagaucauuaccauaggcagcaucugcguggggauuggaaucgucucccugaugcuccaaauugguaacaugguuucuaucugggugaaucacucaauacagacagagaaccagugucaggccgaaaguaucagcaauacuaaauuccuuacggagaaggcuguagcaccugugacccugaugggcaacuccucuuugugcccaauuucggggugggccguccauucaaaagacaauagcaucagaauuggaaguaagggcgauguguuuguuaucagggaaccguucauauccuguucucacuuagagugccggacauuuuuccugacucaaggugcgcuacucaacgacaaacauagcaaugggaccgugaaggaucgcucaccccaccgagcucugauguccuguccugucggagaagccccaagucccuacaacagccguuuugagucuguggcaugguccgccucagcuugccaugacggcacaggcuggcuuaccauugggaucagcggaccugauaauggugcaguagccguucugaaguauaacggcauuaucacugacacaaucaaaaguuggagaaauaacauuuugaggacccaggagucugaaugugcuugcgugaauggguccuguuucacggucaugacugauggaccaagcaacggccaggccucguacaagauauuuaaacucgagaaggguaaaguggugaagucugucgaacuggacgcgcccaacuaucacuacgaggagugcuccuguuauccugaugcaggggaaauuaccugcguuugccgggacaauuggcacggaucaaaccgcccaugggugaguuucaaucagaaccuggaguaccaaaucggcuauaucuguagcggcguauuuggggauaauccgagacccaacgacggaacagguuccugcggcccugugucuccaaauggggccuacggagucaagggcuucagcuuuaaauacgguaacgggguguggauaggcaggacuaagucaaccaauagucgguccggauucgaaaugauuugggaucccaacggcuggacagagaccgacagcucuuuuucaguuaaacaggacaucguggcuaucacggauuggaguggguauagcggauccuucguccagcauccugaacucacugguuuagacuguauucgcccaugcuucuggguggagcugauccgaggcagacccaaggagucuacaauuuggaccucggggagcuccauaucauuuuguggaguaaauagugauacuguuggcuggucuuggccggacggugccgaagugccuuucacaaucgauaaauga

SEQ ID NO: 148381 - RNA, 1410 nt, Artificial Sequence
  derived and/or modified sequence opt3 from neuraminidase__InfluenzaA__EPI5787
augaaccccaaucagaagaucauuaccauaggcagcaucugcaugguggucgggauuaucucccugaugcuccaaauuggaaacaucauaucuaucuggguuucacacaguauucagacagguaaucagcaucaggccgagccuuguaaccaaagcaucauuacuuacgaaaauaacacgugggugaaucagaccuauguaaacaucuccaauacaaacuuccuuacugagaaagcuguggcaucugucacccuggccggcaauucgucauugugcccaauaagcgggugggcggugcacaguaaggacaacggaauuagaaucggcuccaaaggugauguuuuugugauuagggaaccguucaucucuuguagccauuuagagugccggacauuuuuccugacccagggggcucuacucaaugacaagcacuccaacggaacugucaaagaucgcucaccccaucgaacacugaugaguuguccugugggcgaagccccaagccccuacaauucucguuuugaguccguagcauggucagccagcgcuugccacgacggcaccaguuggcuuacgaucgggauuucuggaccugauaacggugcaguugccgugcugaaguauaacggcauaaucacugacaccauuaaguccuggagaaauaacaucuugaggacacaggagagcgaaugugcuugcgucaaugggucguguuucacugugaugaccgauggaccaucuaacggccaagccuccuacaaaauauuuaagauggagaaagguaagguggucaaaucaguugaacucaaugcgcccaacuaucacuacgaggagugcaguuguuauccugacgcaggggaaauuacaugcgugugccgggauaauuggcauggaagcaaccgcccauggguauccuucaaucagaaccuggaguaccagaucggcuacaucuguucuggcguguuuggggacaauccgagacccaacgauggaaccgguagcugcggcccugucucaccaaauggggccuauggagugaagggcuucaguuuuaaguacgguaacgggguuuggauuggcaggacgaaauccacuaauagccggucuggauucgaaaugaucugggaccccaacggcuggacagggaccgauucaaguuuuagcgugaagcaggacauugucgcuauaacugacugguccggauauucugguucguucgugcaacacccugagcugacaggccucgauuguauccgcccaugcuucuggguagaauuaauucgagggagacccaaagagagcaccaucuggacguccggaucaaguaucucuuuuuguggcguuaacagcgacaccguggguugguccuggccggaugacgccgagcugccuuucacaauugauaaguga

SEQ ID NO: 148382 - RNA, 1410 nt, Artificial Sequence; identical to SEQ ID NO: 148381
  derived and/or modified sequence opt3 from neuraminidase__InfluenzaA__EPI5787

SEQ ID NO: 148383 - RNA, 1350 nt, Artificial Sequence; identical to SEQ ID NO: 143081
  derived and/or modified sequence opt3 from neuraminidase__InfluenzaA__EPI267031

SEQ ID NO: 148384 - RNA, 1350 nt, Artificial Sequence; identical to SEQ ID NO: 144661
  derived and/or modified sequence opt3 from neuraminidase__InfluenzaA__EPI376539

SEQ ID NO: 148385 - RNA, 1350 nt, Artificial Sequence
  derived and/or modified sequence opt3 from neuraminidase__InfluenzaA__EPI124069
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaccagcuggcuuacuaucggcauuagugggccugauaacgaggcaguggccguacugaaguauaauggaaucaucacagacaccauuaagucuuggaggaacaauauauugcggacgcaggaguccgaaugcgcuuguguuaacgguagcugcuuuacugugaugaccgauggcccaucggacgggcaggccucuuacaaaaucuucaagauggagaaaggaaaggucgugaaauccguggaacucgaugcgcccaacuaucacuacgaggaguguucaugcuauccugacgcaggcgaaauuacaugugucugccgcgauaauuggcaugguaguaacagaccauggguuagcuuuaaucagaaccuggaguaccaaaucggguauauaugcuccggaguguucggcgacaauccgaggcccaacgauggcacugggucuuguggaccuaugagcccaaauggugccuacggcguaaagggguuuucauucaaguacggaaacggcguguggauuggucggaccaaaaguacaaauucccgcagcggguuugaaaugaucugggaccccaacggcuggaccggaacggacucuucauucagugucaagcaggauaucguggcuauuacugacuggagcggcuauuccgggucuuuuguucagcacccugagcugacaggacucgauugcauccgaccauguuucuggguggaauuaauuagagguaggcccaaagagucgaccauauggacuagcggcuccucaaucaguuucugcggggucaauucugacacagugagcugguccuggccggauggagccgagcugccuuuuaccauugacaaguga

SEQ ID NO: 148386 - RNA, 1350 nt, Artificial Sequence
  derived and/or modified sequence opt3 from neuraminidase__InfluenzaA__EPI342499
augaaccccaaucagaagaucauuaccauaggcagcaucugcauggugauugggaucgucucccugaugcuccaaauuggaaacaugaucucuauauggaucucacacaguauucagaaagguaaucagcauagaacagagagcaucuccaacacuaauccucuuacggaaaaggccguugcuucugugacccugacaggcaacucgucauuguguccaauuagggggugggcaguacacagcaaagacaauaacauccggauaggaaguaagggcgauguguucgucauucgcgagccguuuaucuccugcucucauuuagaaugucgaacuuucuuucugacccagggugcccuacucaaugacaaacacagcaacgggacagugaaggaucguucaccccauagaacccugauguccugcccucuuggagaggcgccaagucccuacaauagcagguucgaaucuguugcuugguccgccucagcaugucacgacggcacuggcuggcugacaauugggaucagcggaccugauaacgaggccguggcugucuugaaguauaaugguaucauuaccgacacgauaaaaaguuggcggaacaauauccuccgcacucaagagucugaaugcgcaugugugaacggcuccugcuuuaccguaaugacagaugggccaagcaacggacaggccucguacaagauuuucaaaaugagaaagggcaaaguugugaagucugucgagcuggacgcucccaauuaucacuacgaagaguguuccugcuauccugauacuggugagaucaccugugugugcagggacaacuggcaugggucaaaucggccauggauaaguuuuaaccagaaucuggaauaccagauuggauauaucugcagcggcaucuucggcgauaacccgcgccccaaugacgggacaggauccugugguccuaugucuccaaacggcgccuacggggugaagggauuuagcuucaaauacggcaauggugucuggauugggcgaaccaagucaacgaacaguagauccggcuuugagaugaucugggaucccaauggauggacugaaacagacagcucuuucucaguuaaacaagacauuguggcgauaaccgauuggaguggcuauagcggguccuuuguacagcacccugagcucacuggauuagacugcaucaggccauguuucuggguggaacugauucggggucgucccaaggagucuacaaucuggaccucgggcagcuccaucucauucugcggggucaacagugauacggugucuuggagcuggccggacggagcagagcuuccuuuuaccauugauaaauga

SEQ ID NO: 148387 - RNA, 1350 nt, Artificial Sequence
  derived and/or modified sequence opt3 from neuraminidase__InfluenzaA__EPI103069
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccaucaaagaucguucaccccauagaacacugaugaguugcccuguuggagaggccccaagccccuauaauucuagguuugaauccguggcauggucagccagcgcuugucacgacggcaccaguuggcuuacuauuggcaucucugggccugauaacggagcagucgccgugcugaaguacaaugguaucauuacagacaccauaaaguccuggcggaacaauaucuugcgcacgcaggagagcgagugcgcuuguguaaacggcucgugcuucacuguuaugaccgaugggccaucuuccggacaggccucauauaaaauuuuuaagauggaaaaaggcaagguggucaaaaguguggagcucgacgcgcccaauuaccauuaugaagaguguagcugcuacccugaugcaggagagaucacaugugugugcagagacaacuggcacggguccaacaggccaugggucucuuucaaucagaaccuggaauaucaaauaggauacauuugcagcggcguuuuuggcgauaauccgcggcccaacgacgggacuggaucaugugguccugugaguccaaauggcgccuacgggguaaagggauucuccuuuaaguauggcaacgguguguggaucgggcgcaccaaaagcacaaauucucgaucaggcuucgagaugaucugggaucccaacggauggaccggcacggacaguagcuuuuccgucaagcaggacauuguggcuaucacugauuggucuggguacucggguagcuucguucagcacccugaacugacaggucucgacugcauuagaccauguuucuggguggaguuaauaaggggccggcccaaagaauccaccaucuggacuucagggaguucuauuagcuuuugcggagucaauuccgauacagugucauggagcuggccggacggcgccgagcugccuuucaccaucgauaaguga

SEQ ID NO: 148388 - RNA, 1350 nt, Artificial Sequence; identical to SEQ ID NO: 148364
  derived and/or modified sequence opt3 from neuraminidase__InfluenzaA__EPI227595

SEQ ID NO: 148389 - RNA, 1410 nt, Artificial Sequence
  derived and/or modified sequence opt3 from neuraminidase__InfluenzaA__EPI569385
augaaccccaaucagaagaucauuaccauaggcagcgugucccugacaaucgccacugucugcuuccucaugcaaauugcuauccuugcaacgaccguuacacugcacuuuaaacagaacgaguguucuauuccuccaaauaaccaggugguaccgugcgaacccaucauaaucgagaagaauauuacugaaaucguguacuugaacaauaccacaauugagaaagaagucuguccugaggugccagaguauagaaacuggucaaagccccagugccaaaucaccggguucgccccuuuuaguaaagacaauagcauaagguuauccgcgggaggugauauuuggguuacucgggaaccauacgugucuuguucgcccggcaagugcuaucaguucgcucuggggcagggaacaacccuaaacaauaagcauucaaacggcacgauccacgaccgcauuccucaucgaacucuccugaugagcgagcuuggugucccauuucaccuggggaccaaacagguguguaucgccuggaguuccucuagcugccaugauggaaaggcaugguugcacguauguguuacaggcgacgaucguaaugccacugcuuccuucaucuacgacggcaugcucgcagauucaauugggaguuggagccaaaacauacugagaacccaggaaucugagugcguguguaucaauggaacaugcaccgucgugaugacggacgguuccgccucaggcagggcugauacucggauucuguuuaucaaagaggggaagauagugcacauuagcccgcucaguggaucugcccagcauaucgaagagugcuccuguuauccccgcuacccugacgucagaugcguuuguagggauaacuggaaaggcagcaaccggccagugaucgacauuaauauggcggauuauucgaucgacucuuccuacguaugcucagguuuagugggggacacaccccgcaacgaugacaguagcuccucuagcaauugucgagauccuaacaaugaaagaggaaacccaggcgucaagggcugggcauucgacaaugggaacgauguguggaugggaaggaccauuucagaggacagucgguccgguuacgaaacuuuucguguuacagauggcuggaccacggccaauagcaagucucaggugaaccgccaaauaaucgucgacaauaacaauuggucaggguauaguggaauuuucagcguggagggcaaauccugcaucaacagauguuuuuacguagagcugaucaggggucggccccaggaaacccgaguuugguggacaucuaauucgauuguggucuucugcgggacuagcggcaccuauggaacaggcuccuggccggauggggcuaacauaaacuuuaugccuaucuga

SEQ ID NO: 148390 - RNA, 1380 nt, Artificial Sequence
  derived and/or modified sequence opt3 from neuraminidase__InfluenzaA__EPI736916
augaaccccaaucagaagauuaccugcaucagcgccacaggcgugacucuguccgucguuucucuccuuauagggaucgcuaaccugggauugaauauugguuuacacuacaaagugucagacaguacgaccaucagcauuccuaacaugaaugagacaaacccaacuaccacaaauaucaccaacauaaucguaaauaagaacgaagagagaacuuuccugaaucuaacaaaaccgcucugugaagugaacuccuggcauauucugucuaaggauaaugcaaucaggauuggcgaggacgcccacauccuugucacccgggaacccuaucugucgugcgauccucaagggugucgcauguuugcguugucacagggaacgacucuccgaggccgucaugcuaacgguaccauacacgacagaagcccauucagggcccugauuaguugggagauggggcaggcacccuccccuuacaauacacggguggagugcaucggauggucuagcacuuccugucaugauggcauuucacgcaugaguaucugcaucagcggcccaaacaacaaugccucugcuguugugugguauagagggaggcccgucaccgaaauuccuuccugggcaggaaacauacugcggacacaggagucagaaugugugugccacaaagguaucuguccaguaguuaugaccgacggcccggccaauaacaaggcugccacgaagauuaucuacuuuaaagaggggaaggugcagaaaauagaggaacuccaaggaaaugcgcagcacauugaggaaugcagcuguuauggcgcagccgguaugaucaagugcgucugccgcgauaacuggaaaggggcuaaucgacccaucauuacuaucgacccugagaugaugacacauaccaguaaguacuuauguucuaagauucugacugauacauccagaccaaacgaccccaccaauggaaacugcgaugccccuauaacgggcggcagcccagaccccggggugaaaggauucgcauuucuugauggugaaaauucgugguugggcaggaccaucucuaaggacucccggucaggguaugagaugcugaaagugccgaacgcugagacagacacucagaguggaccuaccagcuaccaacuaauugucaauaaccagaauugguccggcuacucuggugccuucaucgauuauugggcgaacaaggaauguuuuaaccccugcuucuacguugagcucauccgugggcgcccaaaagaaagcgacgugcuguggacaucaaauaguaugguagcccuuuguggcuccagagagaggcugggaagcuggucuuggcacgauggcgcagaaauuauauauuuuaaguga

SEQ ID NO: 148391 - RNA, 1380 nt, Artificial Sequence; identical to SEQ ID NO: 148010
  derived and/or modified sequence opt3 from neuraminidase__InfluenzaA__EPI593891

SEQ ID NO: 148392 - RNA, 1380 nt, Artificial Sequence
  derived and/or modified sequence opt3 from neuraminidase__InfluenzaA__EPI691380
augaaccccaaucagaagaucgugugcauuagcgucaccggcguuacacuguccgugguaucucuccuuauagggaucacuaaccugggauugaauauugguuuacacuacaaagugucagacaguacgaccaucaacauuccuaauaugaacgagacaaauccaacuaccacaaacaucaccaauauaaucaugaacaagaaugaagagagaacuuuccugaaacuaacaaagccgcucugugaagucaacagcuggcauauucuguccaaagauaaugccaucaggauuggcgaggacgcucacauccuugugacccgggaacccuaucugucuugcgauccucaagggugucgcauguuugcauugucgcagggaacgacucuccgaggccagcaugccaacgguaccauacacgaccguucaccauucagagcgcugauuagcugggagauggggcaggcucccaguccuuacaauacaaggguugagugcaucggaugguccucuacuagcugucaugauggcauuucccggaugucaaucugcaucaguggcccaaacaacaaugccagcgcaguggucugguaucgcgggagacccgugaccgaaauuccuucuugggccggaaacauacugaggacacaagaguccgaauguguaugccacaaggguaucuguccaguugugaugaccgacggcccggcuaauaacaaggcagccacgaaaauuaucuacuuuaaggaggggaaaauacagaagacugaggaacuccagggaaaugcucagcacauugaggaaugcucauguuauggcgccgcggguaugaucaaaugcgucugccgggauaacuggaagggggcaaaucgccccaucauuacaaucgacccugagaugaugacccauacuagcaaguacuuauguaguaaaauucugacagauaccucucgaccaaacgaccccacgaauggaaacugcgaugccccuauaaccggcggcuccccagaccccggggugaagggauucgcuuuucuugauggugaaaauagcugguugggcagaacaaucucgaaagacucuagguccggguaugagaugcugaaggugccgaacgccgagauugacauccaaucaggaccuaucaguuaccagcuagucguuaauaaccagaauuggagcggcuacuccggugcauucauugauuauugggcuaacaaagaauguuuuaaccccugcuucuacguggagcucauacgggggcguccaaaggaaucuggcguacuguggacuagcaauucaaugguggcccuuuguggaagucgcgagagacugggcuccuggagcuggcacgacggggcggaaaucauuuauuuuaaauga

SEQ ID NO: 148393 - RNA, 1413 nt, Artificial Sequence
  derived and/or modified sequence opt3 from neuraminidase__InfluenzaA__EPI533584
augaaccccaaucagaagaucacgugcauuagcgccacaggcaugacucuguccguggucucuaugcucauagggaucgcuaaccuuggacugaauauugguuugcacuacaaaguuucagacaguacgaacaucaauauuccuaacaugaaugagaccagcccaacaacuaccaucauaaacaaucauccgcaaaacaauuucacaaacaucaccaauauuaucgugacuaagaacgaagagggccacuuacugaaucuaacaaaaccccucugugaaguaaacuccuggcauauucugucuaaggauaacgcaaucagaauaggggaggacgcccacauuaucgugaccagggaaccuuaucuuucgugcgauccacagggaugucggauguuugcgcugucacagggcacgacuuugcgcgguaaacaugcuaaugggaccauucacgaccgaagccccuuccgugcccucgucaguugggagaugggacaggcaccuuccccauacaacacaagaguggagugcaucggcuggucuagcacuuccugucacgauggcaucucaaggaugaguauuugcauaagcgggcccaauaacaaugccucugcuguugugugguauggaggucggccugucaccgaaaucccauccugggcaggcaacauucugcgcacacaagagucagaaugugugugccaugggggaaucuguccgguaguuaugaccgacggccccgccaauaacagagcugagacgaagauaauuuacuuuaaggaggguaaaaucaagaaaaucgaggaacugaagggggaugcccagcacauugaagagugcagcuguuauggagcgagugaaaugaucaaaugcauuugcagggacaauuggaagggcgcaaaccggccugugauaacuaucgauccagagaugaugacacauaccucuaaguaccucuguuccaaaauuuuaacugacacaagccgccccaaugauccuaccaacggcaagugcgaggccccaaucaccgggggaucgcccgacccgggugucaaaggcuucgcuuuucuggauggggaaaauucuuggcuuggacgaaccaucuccaaggacucaagaaguggcuaugagauguugaaagugccuaacgccgaaacagacacucagagcggugcaauuucccaccagauaaucgugaauaaccaaaacuggucuggguacagcggcgcuuucauugauuacugggccaauaaggaguguuuuaaccccugcuucuaugucgaacugaucaggggacggccaaaagagucaaguguucuauggaccuccaauagcauuguggcgcucuguggcucuaaggagcgucuggggucauggaguuggcacgacggagccgaaaucauauacuuuaaguga

SEQ ID NO: 148394 - RNA, 1380 nt, Artificial Sequence; identical to SEQ ID NO: 148014
  derived and/or modified sequence opt3 from neuraminidase__InfluenzaA__EPI641400

SEQ ID NO: 148395 - RNA, 1380 nt, Artificial Sequence; identical to SEQ ID NO: 148014
  derived and/or modified sequence opt3 from neuraminidase__InfluenzaA__EPI587620

SEQ ID NO: 148396 - RNA, 1410 nt, Artificial Sequence
  derived and/or modified sequence opt3 from neuraminidase__InfluenzaA__EPI569392
augaaccccaaucagaagaucgugaccauuggcagccugucccucgggcuugucguuuucaacgugcuguugcacgccguaucuauaaucuuaacagugcuggcucuaggaaaaucagagaauaacgguauuugcaauggcacugucgugagagaauacaacgagacgguuaggaucgaaaaggugacccaaugguauaauacaagugucguggaguacguaccucauuggaacgaagggacuuauauuaauaacaccgagccaaucugugacguuaaaggauuugcaccguucagcaaggauaauggcauacggguggguucccgcgggcacaucuuugucauucgagagcccuucgugucuugcucgccugugggaugucguacauuuuuccucacccagggcucacugcuuaacgacaaacauagcaauggcacugucaaggauagaaguccauuuaggacacugauguccguugaaguggggcagucucccaacguauaccaggcccgguucgaggcgguggcuuggagcgccaccgcaugccacgacggaaagaaauggauggccaucggugucacgggcccugauuccaaggcuguggcaguugugcauuaugggggagucccaacugacgugguaaauucaugggccggcgauauuuugcgcacccaagaaaguagcuguacaugcauccaggguaacuguuacuggguuaugacugacgggcccgcuaacagacaggcccaguauaggauauacaaagcgaaucaaggaaagauuaucggccggaaagaugugucuuuuuccggcgggcacauugaggagugcucauguuacccuaacgacggaaaggucgaaugcgugugucgcgauaauuggaccgguacaaaccgaccaguccucaucaucagcccggaccugaguuauagagugggcuaccugugcgcagggcuccccucugauaccccuaggggagaggacacgcaguucguuggcuccugcacuagcccaauggguaaucagggguauggcgugaagggauuuggcuuccggcaggggacagacguaugggucggacguaccauuucgcgcacuucuagauccgguuuugaaauaaucaggauuaaaaacggcuggacacaaaccucaaaggagcagauccggcgacaggugguuguggauaauaguaacuggagcggguacuccggaucuuucacguuacccgucgaacugagcggccgcgagugucuugugccuugcuucuggguagagaugauaagagguaggccagaggaacggaccauuuggacaucaaguuccagcaucgugaugugugggguugacuaugaaaucgccgauuggucuuggcacgacggcgcuauuuugcccuuugauaucgacaaauga

SEQ ID NO: 148397 - RNA, 1368 nt, Artificial Sequence
  derived and/or modified sequence opt3 from neuraminidase__InfluenzaA__EPI459857
augaaccccaaucagaagaucauuaccauaggcagcaucugcauggugauugggacagucucccugaucguucaagugggaaacauuauccucauauggguaaaucacucuauccagacuuguauuacguacgagaacaauaccugggugaaccagacauaugucucaaauacuaacuuccuuaccggucaggccguggcuaguguuacacuggcaggcaauagcuccuugugcccuaucucugggugggccauuuacucgaaagacaacggaaucagaauaggcucaaagggugauguguuugucauuagggaaccauucaucagcuguagucauuuagagugccggaccuuuuuccugacucaaggggcgcuacucaaugacaaacacuccaacggaacaauuaaggaucgcucuccguaucgaacccugaugagcugucccgugggcgaagcuccuuccccauacaauucacguuuugagaguguagccuggagcgcaucugccugccaugacggcaucaacuggcuuacgaucgggauuuccggacccgauaaugaagcuguugcagugcugaaauauaacggugucauaacugacaccaucaagucauggagaaacaauauuuugaggacacaggagagcgagugugccugcgugaacggcaguuguuucacugugaugaccgaugggccuucuaauggacaggcuuccuacaagaucuuuaaaauagaaaagggcaaagucguucggagcguggagcucgacgccccaaacuaucacuacgaagagugcucguguuaccccgaugcgggugagauuacaugcguaugccgcgacaauuggcaugggucuaacagaccuuggguguccuucaaucagaaccuggaauaucaaaccggauacaucuguucaggcgucuuuggcgauaguccaaggccgaaugacgggacgggaagcugcggucccguguccucuaacggcgcauucgggguuaagggauuuagcuucaaauauggcaaugguguguggaucgggcggacuaagacaaccaacucacgcaguggcuuugagaugauuugggauccuaauggauggacugaaacagacuccagcuucucuaugaagcaggacaucauugccauaaccgauuggucaggcuacagugggagcuucguccagcacccagagcugacgggacucaacuguaugcgacccugcuuuuggguggaauuaaucagaggucagccuagggagaauaccauuuggacauccgggucuucgaucagcuucuguggcguaaacuccgagacuguuggauggucauggccagacggcgcugaacugcccuuuaccaucgauaaauga

SEQ ID NO: 148398 - RNA, 1416 nt, Artificial Sequence
  derived and/or modified sequence opt3 from neuraminidase__InfluenzaA__EPI242204
augaaccccaaucagaagcuguucgcccucagcggcguggcuaucgcacuuuccguccugaacuuguuaauugggauaucuaauguuggacugaacgugucacuacaccucaaaggugagggcguaaagcaagaaaauaaccugaccugcacaacuaucacgcagaauaacaccacaguggucgagaauacuuacgugaacaauaccacaauuaucaacaaagggaccaaucuuaaggccccuaacuaucuguugcucaauaaaagucuguguagcguugaaggauggguggucauugcgaaggacaacgcuaucagauuuggcgaguccgaacagauaaucgugacuagggagccauacguaucuugcgauccgucggguuguaagauguaugcccugcaucaggggacaaccauucggaacaaacacucaaauggaacgauccaugaccgcacuaccuuccgaggccucauuagcacacccuuaggcacuccuccaaccguuaguaacuccgauuuuaucugcgugggguggucuagcacauccugucacgacggagucggucguaugaccauaugcauucaaggcaauaacgauaaugcaacggccacuguguacuauaacagaaggcugacaaccacuaucaagacaugggcuaaaaauauucuucggacccaggagucagaaugugugugccauaacgggacgugugcagucguuaugaccgacggacccgccaguagccaggcuuacacaaagaucauguauuuccacaaaggcuugaucauuaaggaggaaccucugcgcgguucugccagacacauagaggagugcuccuguuacgggcaugaucagaaggugucaugcguaugcagggacaauuggcaaggagcgaaccggccaaucauugaaaucgauaugagcacucuagagcacaccagucgcuacguguguacaggcguccucacugacaccucucgacccggcgauaaaccuaauggggacugcuccaacccaauaacaggaagcccgggugcacccggcgugaagggguuuggauuccugaauggcgauaacaccuggcuugguagaacuauuucgccuaggucucgguccggguuugaaaugcugaaaaucccaaaugccgagacggaccccaacucacguaucauugaacgccaggagaucguugacaacaguaauuggagcggcuauuccggaucuuucauugauuacugggacgaggcuaacgaauguuauaauccuugcuuuuacguggaguugauaagaggcaggccagaagaggccaaguaugucugguggacaagcaacucacucaucgcacugugugggagucccguguccguaggaagcgguucuuucccggauggcgcucagauucaguacuuuucauga

SEQ ID NO: 148399 - RNA, 1416 nt, Artificial Sequence
  derived and/or modified sequence opt3 from neuraminidase__InfluenzaA__EPI408029
augaaccccaaucagaagcuguucgcccucagcggcguggcuaucgcacuuuccguccugaacuuguuaauugggauaucuaauguuggacugaacaugucacuacaccucaaaggugagggcgugaagcaagaaaauaaccugaccugcacaacuaucacgcagaauaacaccacaguaguggagaauacuuacgucaacaauaccacaauuaucaacaaagggaccaaucuuaaggccccuaacuaucuguugcucaauaaaagucuguguagcguggaaggauggguugugauugcgaaggacaacgcuaucagauuuggcgaguccgaacagauaaucgucacuagggagccauacgugucuugcgauccgucggguuguaagauguaugcccugcaucaggggacaaccauucggaacaaacacucaaauggaacgauccaugaccgcacuaccuuccgaggccucuuaagcacaccccugggcacuccuccaaccguaaguaacuccgauuuuauuugcguuggguggucuagcacauccugucacgacggagugggucguaugaccaucugcauacaaggcaauaacgauaaugcaacggccacugucuacuauaacagaaggcuuacaaccacuauuaagacaugggcuaaaaauaucuugcggacccaggagucagaaugugugugccauaacgggacgugugcaguggucaugaccgacggacccgccaguagccaggcuuacacaaagauuauguauuuccacaaaggccugaucaucaaggaggaaccucuacgcgguucugccagacacauugaggagugcuccuguuacgggcaugaucagaagguuucaugcgugugcagggacaauuggcaaggagcgaaccggccaauaaucgaaauugauaugagcacucucgagcacaccagucgcuacguauguacaggcgugcugacugacaccucucgacccggcgauaaaccuaauggggacugcuccaacccaaucacaggaagcccgggugcacccggcgucaagggguuuggauuccuuaauggcgauaacaccuggcuggguagaacuauaucgccuaggucucgguccggguuugaaauguugaaaauuccaaaugccgagacggaccccaacucacguaucaucgaacgccaggagauuguggacaacaguaauagaagcggcuauuccggaucuuucaucgauuacugggacgaggcuaacgaauguuauaauccuugcuuuuacguugagcucauuaggggccggccagaagaggccaaguaugugugguggacaagcaacucacugauagcauuaugugggagucccgucuccgugggaagcgguucuuucccggauggcgcucagauccaguacuuuucauga

SEQ ID NO: 148400 - RNA, 1398 nt, Artificial Sequence; identical to SEQ ID NO: 145470
  derived and/or modified sequence opt3 from neuraminidase__InfluenzaA__EPI439509

SEQ ID NO: 148401 - RNA, 1350 nt, Artificial Sequence; identical to SEQ ID NO: 148003
  derived and/or modified sequence opt3 from neuraminidase__InfluenzaA__EPI164223

SEQ ID NO: 148402 - RNA, 1398 nt, Artificial Sequence; identical to SEQ ID NO: 145470
  derived and/or modified sequence opt3 from neuraminidase__InfluenzaA__EPI486493

SEQ ID NO: 148403 - RNA, 1398 nt, Artificial Sequence
  derived and/or modified sequence opt3 from neuraminidase__InfluenzaA__EPI740737
augaaccccaaucagaagauccugugcaccagcgccacagcuauuacuauauccgcaaucgccgugcucauuggcaucgcgaaccuugggcugaauauuggauugcacuuaaaaccugguuguaacugcucucauucacaaccagagacgaccaauacaagucagacuaucauaaacaauuacuauaacgaaaccaauaucacaaacauucagaucgaggaaagaaccagcaggaauuucaacaaucugacuaagggccuauguacaauuaacuccuggcacaucuacgggaaagacaaugcuguccggauaggagagucuucggauguucucgugacccgcgaaccguauguaucaugcgaccccgaugagugucgauuuuacgcccugagccagggcacgacuauucgugguaagcauaguaacgggaccauccacgacagaucccaauauagggcacuuauuucuuggccucugagcuccccacccacagugcauaacucacgggucgagugcaucggauggaguagcacuucuugucacgauggcaaaucccgcaugucaaucugcauuagcggcccuaauaacaaugccagugcugugguuugguacaacagaaggccaguggcagaaauaaauaccugggcccggaacaucuugcgcacacaggagucugaaugugucugccacaauggggugugucccguaguuuucaccgacggaccugcuacggguccagccgauacucgaauuuauuacuuuaaggagggcaagauccucaaaugggagucccugacagggaccgcgaagcauauagaagagugcagcugcuacggagaaagaacuggcauuacauguaccugcagggacaacuggcaggguucgaaucggccggugguccagaucgaucccguggcaaugacgcacaccucucaauauaucuguuccccugugcugacagacucaccacgucccaacgauccuaauauugggaaaugcaacgacccauaccccggaaauaacaauaacggcgucaagggcuucaguuaucucgauggggccaacacuugguuaggacgcaccaucagcacagcuuccagaucugguuacgagaugcugaaaguuccgaaugcccuuacugacgacaggagcaagccuauucagggccagaccauaguguugaacgcagauuggucaggguauaguggauccuuuauggacuacugggcugaaggcgauuguuaucgggccugcuucuacguagagcugauccgaggucgccccaaggaggacaaagugugguggacaagcaauucuauugucucaauguguaguagcaccgaauuucuagggcaguggaacuggccagauggcgcgaagaucgaguacuuccucuga

SEQ ID NO: 148404 - RNA, 1398 nt, Artificial Sequence
  derived and/or modified sequence opt3 from neuraminidase__InfluenzaA__EPI730494
augaaccccaaucagaagauccugugcaccagcgccacagcuauuacuauaggcgcaaucgccgugcucauugggaucgcgaaccuuggacugaauauugguuugcacuuaaaaccuggcuguaacugcucccauucucaaccagagaucacgaauaccucacagacaauaaucaacaauuacuauagugaaacuaacauuaccaauauccagauggaggaaagaacaagcaagaacuucaauaaccugaccaaagggcuauguacuauuaauuccuggcacaucuacggaaaggacaacgcugucaggauaggcgagucuucggauguucucgugacacgggaaccguauguaucaugcgaccccgaugagugucgcuuuuacgcccugagccaggguaccacgauucgagggaaacauaguaauggaacuauccacgaccguucccaauauagagcacuuauuucuuggccucugagcuccccacccaccguguacaacucaagggucgagugcaucggcuggaguagcacaucuugucaugauggcaagucccggaugucaaucugcauuagcgggccuaacaauaacgccagugcugugguuugguauaaucgcagaccaguggcagaaauaaacacuugggccaggaauaucuugcggacccaggagucugaaugugucugccacaacggagugugucccguaguuuucacagacgguuccgcuaccggcccugccgauacgcgcauuuacuacuuuaaggaggggaaaauccucaagugggagagccugacuggaacagcgaaacacauagaagagugcucgugcuauggcgaacgaaccgguauuacuuguacaugcagagacaauuggcaggggucuaacaggccagugauccagaucgauccggucgcaaugacccauacgucccaauacauuuguucacccgugcugaccgacaauccucggccaaacgaucccaauaucggaaagugcaacgacccuuauccaggcaauaacaauaacggcauuaaaggguucaguuaccucgauggagccaacacaugguuaggucguacuauaagcaccgcuucccgcucuggcuaugagaugcugaaggugcccaaugcccuuacagacgacagaagcaagccgauccaggggcagacuauugucuugaacgcagauuggucaggauacaguggcuccuuuauggacuauugggcugaaggugauuguuacagggccugcuucuacguugagcugauccgggggcgaccuaaagaggacaaggugugguggaccagcaauucuaucguaucaauguguaguagcacagaauuucuaggccaguggaacuggcccgauggagcgaaaauugaguauuuccucuga

SEQ ID NO: 148405 - RNA, 1398 nt, Artificial Sequence
  derived and/or modified sequence opt3 from neuraminidase__InfluenzaA__EPI712925
augaaccccaaucagaagauccugugcaccagcgccacagcuauuacuauaggcgcaaucgccgugcucauugggaucgcgaaccuuggacugaauauugguuugcacuuaaaaccuggcuguaacugcucccauucucaaccagagacgaccaauacaucacagacuaucauaaacaauuacuauaacgaaaccaauaucacaaacauucagaucgaggaaagaaccaguaggaauuucaacaaucugacuaaggggcuauguacaauuaacagcuggcacaucuacggaaaagacaaugcuguccggauaggcgaguccucugauguucucgugacccgcgaaccguauguaucgugcgaccccgaugagugucgauuuuacgcccugucacaggguacgacuauucgugggaagcauagcaacggaaccauccacgacagaagucaauauagggcacuuauuuccuggccucugucuagcccacccacagugcauaacucccgggucgagugcaucggcuggucaaguacuagcugucacgauggcaaaucucgcauguccaucugcauuucagggccuaauaacaaugccagcgcugugguuugguacaacagaaggccaguggcagaaauaaauaccugggcccggaacaucuugcgcacacaggagagugaaugugucugccacaauggagugugucccguaguuuucaccgacgguccugcuacgggcccagccgauacucgaauuuauuacuuuaaggaggggaagauccucaaaugggagucucugacaggaaccgcgaagcauauagaagagugcuccugcuacggcgaaagaacugguauuacauguaccugcagggacaacuggcaggggagcaaucggccggugguccagaucgaucccguggcaaugacgcacaccucgcaauauaucuguucuccugugcugacagacuccccacgucccaacgauccuaauauuggaaaaugcaacgacccauaccccggcaauaacaauaacggcgucaagggguucucauaucucgauggagccaacacuugguuaggucgcaccaucaguacagcuagcagauccggcuacgagaugcugaaaguuccgaaugcccuuacugacgacaggucuaagccuauucaggggcagaccauaguguugaacgcagauuggagcggauauucaggcaguuuuauggacuacugggcugaaggugauuguuaucgggccugcuucuacguagagcugauccgagggcgccccaaggaggacaaagugugguggacauccaauagcauugucucuauguguucaaguaccgaauuucuaggccaguggaacuggccagauggagcgaagaucgaguacuuccucuga

SEQ ID NO: 148406 - RNA, 1398 nt, Artificial Sequence
  derived and/or modified sequence opt3 from neuraminidase__InfluenzaA__EPI448938
augaaccccaaucagaagauccugugcaccagcgccacagcuauuauaaucggcgcaauugccgugcucaucgggauggcgaaccuuggacugaauauugguuugcacuuaaaaccuggcuguaacugcucccauucucaaccagagacuacgaauaccucacagacaaucauaaacaauuacuauaacgaaacuaauaucaccaacauucagauggaggaaagaacaaguaggaauuucaacaaucugaccaaggggcuauguacuaucaacagcuggcacauuuacggaaaagacaaugcuguccggaucggcgaguccucugauguucucgugacacgcgaaccguauguaucgugcgaccccgaugagugucgauuuuacgcccugucacaggguaccacgauacgugggaagcauagcaacggaacuauucacgacagaagucaauauagggcacuuaucuccuggccucugucuagcccacccaccguguacaacucccgggucgagugcauuggcuggucaaguacaagcugucaugauggcaaaucucgcauguccaucugcaucucagggccuaauaacaaugccagcgcugugguuugguauaacagaaggccaguggcagaaauuaauacuugggcccggaacauauugcgcacccaggagagugaaugugucugccacaauggagugugucccguaguuuucacagacgguucugcuaccggcccugccgauacgcgaaucuacuacuuuaaggaggggaagauucucaaaugggagucccugacuggaacagcgaagcacaucgaagagugcagcugcuauggcgaaagaaccgguauaacuuguacaugcagggacaacuggcaggggucgaaucggccagugauucagaucgauccggucgcaaugacccauacgucucaauacaucuguucccccgugcugaccgacaacccucguccaaaugaucccaacauuggaaaaugcaaugacccuuauccaggcaacaauaacaacggcgugaagggguucucauaccucgauggagccaauacaugguuaggucgcacuaucaguaccgcuagcagauccggcuaugagaugcugaaaguccccaacgcccuuacagacgacaggucuaagccgauucaggggcagacuauaguuuugaaugcagauuggagcggauacucaggcaguuuuauggacuauugggcugaaggugauuguuaccgggccugcuucuacguggagcugauccgagggcgcccuaaggaggacaaaguaugguggaccuccaacagcauugugucuauguguucaaguacagaauuucuaggccaguggaauuggcccgauggagcgaagaucgaguauuuccucuga

SEQ ID NO: 148407 - RNA, 1410 nt, Artificial Sequence
  derived and/or modified sequence opt3 from neuraminidase__InfluenzaA__EPI445995
augaaccccaaucagaagaucauugcccugggcagcgcuucccucaccauagcaaucauuugccuucugauccaaauugccaucuuggcgacaacuaugacguuacacuucaugcagaacgagcauaccaauucuacaagaaacaaaguggucccuugugaaucaauaaucauugagaggaauaucacugaaauuguucaccugaacgggaccaucauagagaaggaaaguugcccaaaagcuguggaguacaagaauuggagcaaaccgcagugucagauuacaggauuugcccccuucuccaaggacaacucuauccggcuaucggccgguggcgauauuuggguaacccgcgagccuuaugugucaugcagccucaguaaguguuaccaauuugcacuggggcagggaacuacacuuaauaaccgacauuccaauggcaccacgcacgaccguucuccauauagaacucuguugaugagcgaacucgguguccccuuccaucuggggaccaaacaggugugcaucgcuugguccucaaguagcugucacgauggaagggcauggcugcacguuugcgugacaggcgacgauaagaacgccacugcuucugucaucuacggcgggaugcucaccgacuccauuggaucauggagcaaaaauauauuacggacacaggagagugaaugugugugcaucaacgguaccuguacgguaguuaugacugauggcucugccuccgggcgcgcggacacacggauucuguuuaucagggagggaaagauagugcauauuagcccucuuucgggcucugcacaacacgucgaggaaugcuccugcuauccacgguaccccgaggugcgcugugugugccgagauaauuggaaagguucaaacagaccugucuuguauaucaacguugccgacuacaguaucgauagcuccuacguguguucugggcugguaggagacaccccaaggaaugaagauagcucaaguuccagcaacugccgggacccgaauaacgagcguggcggccccggggugaagggaugggcuuucgacaauggugaugacgucuggaugggccgcacuauuaagaaagauucuagagccggguaugaaacauuuagggugguugacggauggacccuagcaaacucaaagagucagacgaauagacaggugaucgucgauagcgacaacugguccggcuacucugguauguucucgguggaggggaaaaccuguauuaaucgaugcuuuuauguagagcucauacgcggcagaccucaggaaacaaggguuugguggacuagcaacuccaucauuguguucuguggaaccucaggcacauacgggacuggaaguuggccagauggugcugacaucaauuuuaugucuaucuga

SEQ ID NO: 148408 - RNA, 1410 nt, Artificial Sequence
  derived and/or modified sequence opt3 from neuraminidase__InfluenzaA__EPI470861
augaaccccaaucagaagaucauugccauaggcagcgugucccugaccaucgcuacaauuugccuccuuaugcaaaucgcaauucuggccacuacgaugaccuugcacuucaaacagaacgaguguaucaauucuucaaacaaucaggucguuccuugcgaaccaauaaucauugagagaaacaucacagaaauugugcauuuaaauaguacuacccuggagaaggaaaucuguccgaaaguagcggacuacaggaacuggagcaagccccagugccaaauaacaggguuugcuccuuucuccaaagauaauucuauucggcuaucggccggaggugacaucugggugacccgcgagccauaugucucauguggccucgggaagugcuaccaguuugcacugggacagggcacuacacuugagaacaagcacagcaaugguaccgcccaugaucgaacgccccaccguacucuguugaugaacgaacucggggugccuuuccaucuggcuaccaaacagguuuguauugcauggaguuccucuagcugccacgacggaaaggccuggcugcacgugugugucacaggcgaugacagaaaugcuacugccuccaucaucuaugauggcauucucguggacucaauagggaguuggagcaaaaacaucuuaaggacccaagagucugaaugcguauguauuaauggaacaugcgcgguugugaugaccgaugguuccgcaucaggccgggccgacacgcgcauccuguuuauaagagaggggaagauugcucauaucagcccacuuaguggaucugcccagcacgucgaggaaugcuccuguuaccccagguauccugaggugcggugcgugugucgcgauaacuggaaaggcagcaaccgaccagucuuguacaucaauauggcaaacuauucgauugacucuuccuacguuugcucaggucuggugggggauacuccgagaaaugacgacaggaguagcuccucuaacugucgggaucccaauaacgaacguggagcuccuggcguaaagggcugggccuucgacaaugggaacgauaucuggaugggacgcacaauuaagaaagacagcagaucagguuacgagaccuuuagggugauaggcggguggacuacagcgaauaguaagucccagaucaaccggcaggucauuguggauagcgacaauucuucaggauauaguggcaucuucagcguugaagguaaauccugcaucaaccgauguuuuuacguggagcuaauucgcgggagaccaaaggagaccagggucugguggacgucuaauucgauaaucguguucugcggcaccagcggaacauauggcacuggguccuggcccgauggagccaacauuaauuuuaugccuaucuga

SEQ ID NO: 148409 - RNA, 1401 nt, Artificial Sequence
  derived and/or modified sequence opt3 from neuraminidase__InfluenzaA__EPI498036
augaaccccaaucagaagaucauugccauaggcagcgugucccugaucauugcuaucauuugccuccuuaugcaaaucgcaauacugaccacaacuaugacguugcacuucagacagaacgaguguucuaauccuucaaacaaucaggucaugccaugcgaaccgaucauuuuagagaggaacaccguucaucugaauaguacaaucauugaacgggagaucugucccaaaguggccgacuacaagaacuggagcaaaccucagugccaaauaacuggguuugcgccauucuccaaggauaauucuauucgccuaucggcuggaggugacaucuggguaacccgagaacccuaugugucauguagccucgauaaaugcuaccaguuugcccugggccaggggacaacccuuaagaacaagcacaguaauggaacuacacaugaccguaccccucacagaacgcuguugaugaacgagcucggcgucccauuccaucuggguacuaaacagguguguauugcaugguccucuagcuccugcuaugaugggaaggccuggcugcacaucuguguuaccggagacgauaaaaaugcuacagcaucaaucauuuacgacggcaugcucguggauaguauaggcagcuggucuaagaacaucuuaaggacucaagaguccgaaugcgucuguauuaaugggaccugcgccgugguaaugacagacggaucagcuagcgguaaagccgauacccggguucuguuuauccgcgagggcaagauaauuaacaucaguccccuuucuggguccgcgcagcacguggaagagugcagcuguuauccuagauacccagaggucaggugcgugugucgggacaacuggaagggaucgaaucgcccgaucuuguauauuaacauggcagauuacucuaucgaauccucauacgugugcaguggccuggucggugacacgccccgaaaugacgauagcuccucuagcucaaacuguagagacccuaauaacgagaggggagccccagggguuaaaggcugggcuuucgaugacggcaaugauguguggauggggcggacuauuaagaacggaagucguuccgguuaugaaacauuucgcguagugaauggcuggaccauggccaacagcaaaucucagauaaauagacaggucaucguggacucagaugacuggaguggguacagcggaauuuucuccguugagggcaagaaaugcaucaacagguguuuuuauguggaacuaauccggggucgaccccaagagccucgcgucugguggacuucuaauucgauuauaguguucugcgggacaagcggcaccuacggaacgggcuccuggccagauggggcaaacaucaauuuuaugcccguauga

SEQ ID NO: 148410 - RNA, 1410 nt, Artificial Sequence
  derived and/or modified sequence opt3 from neuraminidase__InfluenzaA__EPI470902
augaaccccaaucagaagaucguggccauuggcagcgcuucccugaccauagcaacaaugugccuccuuaugcagaucgcccuguucgcgacuacgaugaccuugcacuuuaaacagacaggguguacuaacucuucagacaaucaggcugucccuugcggaccaauuaucauugagagaaacaucaccgaaauaguucauuuaaauaguacaacccuggagaaggaaacuuguccgaaaagcgccgguuacaggaacugguccaagccccagugccaaaucacaggcuucgcaccuuuuucuaaagauaauucgauucggcuagccgcugcaggggacaucugggugacccgcgagccauauguaucauguggacucggcaagugcuaccaguucgcccugggucaggggacgacucuugauaacaagcacagcaauggaaccacacaugaccgaacuccccaccguacccuguugaugaacgaacucggcgugccuuuucaucuggcuacaaaacaggucuguauugccuggaguuccucuagcugccacgauggcaaggcguggcugcacguguguguuaccggggacgauaaaaaugcaacggccuccaucauauaugacgguauucucguggauucaaucgcuaguuggagcaagaacauuuuaagaacucaagagucugagugcgucuguaucaauggaacaugcaccgugguaaugacugacggcuccgccucagggagggcagauacacggauccuguucauucgcgaaggaaaaauaguucauaucagcccacuuaguggcucugcucagcacguggaggaaugcuccuguuaccccagauauccugaggucaggugcgugugucgggacaacuggaaggguagcaaucgcccaguguuguuuauuaacauggccgauuacucgaucgacucuuccuaugucugcucagggcugguuggagacaccccgcgaaacgaugacagaaguagcuccucuaauuguagggaucccaacaaugagcggggcgcgccuggcgugaaggggugggccuucgacagcggaaacgauauauggaugggucguacgauugaaaaagacucacgcaguggcuacgagaccuuuagaguaaucgggggaugguccacagcaaauagcaagucucagaucaacaggcaagugauugucgaucgggacaauucaaguggcuacagcgguaucuucuccguggaagggaaaucuugcauuaaccgauguuuuuauguugagcuaauacgcggcagaccaaaggaaaauagggugugguggacuucgaacagcaucauugucuucugcggaaccuccggcacauacgggacuggaucauggcccgauggugcuaauaucaaccucaugccuaucuga

SEQ ID NO: 148411 - RNA, 1401 nt, Artificial Sequence
  derived and/or modified sequence opt3 from neuraminidase__InfluenzaA__EPI838241
augaaccccaaucagaagaucaccgccauuggcagcgugucccugauaaucgcuauuaucugccuccuuaugcaaauugcaauccugacaacuacgaugaccuugcacuucagacagaacgaguguucuaauucaaguaacaaucaggucaugccuugcgaaccaauaaucauugagaggaacacaguucauuuaaauagcacuaccaucgaacgggagauuuguccgaaaguggccgaauacaagaacugguccaaaccccagugccaaaucacaggguuugcgccuuucucuaaggacaauucgauacgccugucagcuagcggagauauuuggguaacccgagagccauaugugaguuguucccuagacaaaugcuaccaguuugcccucggucagggcacuacacugaagaacaagcacucuaaugggaccgcacaugaucguacgccccacagaacucuucugaugaacgaguugggagucccuuuccaucucggcaccaaacagguguguaucgccuggagcuccucaaguugcuaugacgguaaggcuuggcugcacguuugugugacaggggaugacaaaaaugcaacugccagcauuaucuacgauggaaugcuggucgacucuaucggcuccuggucaaagaacauucucaggacccaagaaagcgagugcguguguauaaauggcacaugcgcuguaguuaugaccgaugggagugccucuggaaaagcggacacgcggguguuauuuauccgcgaagguaagauuaucaacauauccccacugagcggcucggcacagcacgucgaggagugcucuuguuaucccagauacccugaagugaggugcgugugucgggauaacuggaagggguccaaucgcccaauucuuuauaucaacauggccgacuacucaaucgagaguagcuacgucugcuccggauugguuggcgauacuccgcgaaaugacgacucuagcucaaguuccaacuguagagaucccaauaacgaaaggggugcuccuggggugaaaggaugggccuucgacgauggcaaugacguauggaugggccggacaauuaagaacgggagccguucuggauaugagaccuuucgcguggucaaugguuggacuauggcaaacucaaaaagucagaucaauagacaggugauuguugaaagcgaugacugguccggcuacucugggauauucucgguggagggaaagaaaugcaucaacagguguuuuuaugucgagcugauucggggccgaccacaagaaccccgcgugugguggacaagcaauuccaucaucguauucugcgguaccucagggacguacggcaccggaaguuggccugauggcgcuaacauuaauuuuaugccaauauga

SEQ ID NO: 148412 - RNA, 1401 nt, Artificial Sequence; identical to SEQ ID NO: 148411
  derived and/or modified sequence opt3 from neuraminidase__InfluenzaA__EPI680525

SEQ ID NO: 148413 - RNA, 1401 nt, Artificial Sequence; identical to SEQ ID NO: 148019
  derived and/or modified sequence opt3 from neuraminidase__InfluenzaA__EPI690481

SEQ ID NO: 148414 - RNA, 1755 nt, Artificial Sequence
  derived and/or modified sequence opt3 from hemagglutinin__InfluenzaB__ABL76276
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaagucgcuccggguucuuugcaaccauggccugggcuguuccaagagacaauaacaaaacggccacuaauccgcugacaguggaggucccccacaucuguaccaaggaagaggaucagauuacuguguggggauuccauucugacaacaaaacacagaugaagaaucuguacggugauagcaacccucaaaaguuuaccuccucagcgaauggcgugacgacccacuaugucagucagaucgggggauucccagaccagacagaggauggcggucucccccagagcgggaggauaguuguggacuacaugguacaaaaaccuggaaagacuggcaccauuguguaucagcggggcaucuuacugccacagaaagucuggugcgcaucugggcgcuccaaggugauuaaaggaucacuucccuugaucggugaagccgauugucugcacgagaaguacggcgggcuaaacaaaagcaagccguauuacacaggagaacaugcuaaggccaucggcaacugcccuauuuggguuaaaacuccccucaagcuggcaaaugguaccaaauaccgaccuccagcuaaacuucugaaggagagaggguuuuucggcgccauagcgggauuuuuggagggcgggugggaaggaaugaucgccgguuggcacggcuauacaagucauggggcacacggaguggcugucgccgcugaccucaagucuacccaggaggccauuaacaagaucacuaaaaaucugaacuccuuaagcgaacuggaggugaagaaucuccaaaggcuuucgggcgcaauggaugaacugcacaacgagauauuggagcuagacgaaaaaguagacgaucugcgggccgacacgauuucuucccagaucgagcucgcuguucugcuuucaaaugaagguaucauuaacagugaggaugaacaucuguuggcgcucgagcguaagcugaaaaagauguuagggcccagcgcaguggacaucggcaauggauguuucgagacaaagcacaaaugcaaccagaccugccuggaucgcauugccgcuggcacuuuuaaugccggggaguucucccuaccaaccuuugacucucucaacauaacagcagccagccugaaugaugacggacuugauaaccauaccaucuugcuguacuauucaacugcugccaguucccucgcagucacacugaugauugcgaucuucaucguguacaugauuagcagagacaaugucucuuguucaauaugccuuuga

SEQ ID NO: 148415 - RNA, 1755 nt, Artificial Sequence
  derived and/or modified sequence opt3 from hemagglutinin__InfluenzaB__ABL76287
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacaauugaggucccccacaucuguaccaaggaagaggaucagauuacuguguggggauuccauucugacaacaaaauccagaugaagaaucuguacggugauagcaacccucaaaaguuuacauccucagcgaauggcgugaccacgcacuaugucagucagauagggggauucccagaccagaccgaggauggcggucucccccagagcgggaggauuguuguggacuacaugguacaaaaaccuggaaagacaggcacuaucguguaucagcggggcauuuuacugccacagaaagucuggugcgcaucugggcgcuccaaggugaucaaaggaucacuucccuugaucggugaagccgauugucugcacgagaaguacggcgggcuaaacaaaagcaagccguauuacaccggagaacaugcuaaggccauuggcaacugcccuauauggguuaaaacaccccucaagcuggcaaaugguacuaaauaccgaccuccagcuaaacuucugaaggagagaggguuuuucggcgccaucgcgggauuuuuggagggcgggugggaaggaaugauugccgguuggcacggcuauaccagucauggggcacacggaguggcugucgccgcugaccucaagucuacacaggaggccaucaacaagauaaccaaaaaucugaacuccuuaagcgaacuggaggugaagaaucuccaaaggcuuucgggcgcaauggaugaacugcacaacgagauuuuggagcuagacgaaaaaguagacgaucugcgggccgacacuaucucuucccagaucgagcucgcuguucugcuuucaaaugaagguauuaucaacagugaggaugaacaucuguuggcgcucgagcguaagcugaaaaagauguuagggcccagcgcaguggacauuggcaauggauguuucgagacgaagcacaaaugcaaccagacaugccuggaucgcauagccgcuggcaccuuuaaugccggggaguucucccuaccaacuuuugacucucucaacaucaccgcagccagccugaaugaugacggacuugauaaccauacaauuuugcuguacuauucaaccgcugccaguucccucgcagucacucugaugaucgcgaucuucauuguguacaugauaagcagagacaaugucucuuguucaaucugccuuuga

SEQ ID NO: 148416 - RNA, 1755 nt, Artificial Sequence
  derived and/or modified sequence opt3 from hemagglutinin__InfluenzaB__ABL76298
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacagucgaggugccccacauuuguaccaaggaagaggaucagaucacuguguggggauuccauucugacaacaaaacacagaugaagaaucuguacggugauagcaacccucaaaaguuuaccuccucagcgaauggcgucacgacccacuauguuagucagauugggggauucccagaccagacagaggauggcggucucccccagagcgggaggaucgugguagacuacauggugcaaaaaccuggaaagacuggcaccauagucuaucagcggggcauuuuacugccacagaaaguguggugcgcaucugggcgcuccaagguuaucaaaggaucacuucccuugauuggugaagccgauugucugcacgagaaguacggcgggcuaaacaaaagcaagccguauuacacaggagaacaugcuaaggccaucggcaacugcccuaucugggugaaaacuccccucaagcuggcaaaugguaccaaauaccgaccuccagcuaaacuucugaaggagagaggguuuuucggcgccauugcgggauuuuuggagggcgggugggaaggaaugauagccgguuggcacggcuauacaagucauggggcacacggagucgcuguggccgcugaccucaagucuacccaggaggccaucaacaagauuacuaaaaaucugaacuccuuaagcgaacuggagguaaagaaucuccaaaggcuuucgggcgcaauggaugaacugcacaacgagaucuuggagcuagacgaaaaaguugacgaucugcgggccgacacgauaucuucccagauugagcucgcugugcugcuuucaaaugaagguaucaucaacagugaggaugaacaucuguuggcgcucgagcguaagcugaaaaagauguuagggcccagcgcagucgacauuggcaauggauguuucgagacaaagcacaaaugcaaccagaccugccuggaucgcaucgccgcuggcacuuuuaaugccggggaguucucccuaccaaccuuugacucucucaacauuacagcagccagccugaaugaugacggacuugauaaccauaccauauugcuguacuauucaacugcugccaguucccucgcagugacacugaugaucgcgauuuucaucgucuacauggugagcagagacaauguuucuuguucaaucugccuuuga

SEQ ID NO: 148417 - RNA, 1755 nt, Artificial Sequence
  derived and/or modified sequence opt3 from hemagglutinin__InfluenzaB__ABL76309
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacagucgaggugccccacauuuguaccaaggaagaggaucagaucacuguguggggauuccauucugacaacaaaacacagaugaagaaucuguacggugauagcaacccucaaaaguuuaccuccucagcgaauggcgucacgacccacuauguuagucagauugggggauucccagaccagacagaggauggcggucucccccagagcgggaggaucgugguagacuacauggugcaacggccuggaaaaacuggcaccauagucuaucagcgcggcauuuuacugccacagaagguguggugcgcaucugggcgauccaaaguuaucaagggaucacuucccuugauuggugaagccgauugucugcacgagaaauacggcgggcuaaacaagagcaaaccguauuacacaggagaacaugcuaaggccaucggcaacugcccuaucugggugaagacuccccucaaacuggcaaaugguaccaaguacagaccuccagcuaaacuucugaaggagaggggguuuuucggcgccauugcgggauuuuuggagggcgggugggaaggaaugauagccgguuggcacggcuauacaagucauggggcacacggagucgcuguggccgcugaccucaaaucuacccaggaggccaucaacaagauuacuaagaaucugaacuccuuaagcgaacuggagguuaaaaaucuccaacggcuuucgggcgcaauggaugaacugcacaacgagaucuuggagcuagacgaaaagguagacgaucugcgugccgacacgauaucuucccagauugagcucgcugugcugcuuucaaaugaagguaucaucaacagugaggaugaacaucuguuggcgcucgagcgcaaacugaagaaaauguuagggcccagcgcagucgacauuggcaauggauguuucgagacaaagcacaagugcaaccagaccugccuggauagaaucgccgcuggcacuuuuaaugccgaagaguucucccuaccaaccuuugacucucucaacauuacagcagccagccugaaugaugacgggcuugauaaccauaccauauugcuguacuauucaacugcugccaguucccucgcagugacacugaugaucgcgauuuucaucgucuacaugaucagcagggacaaugugucuuguucaauuugccuuuga

SEQ ID NO: 148418 - RNA, 1755 nt, Artificial Sequence
  derived and/or modified sequence opt3 from hemagglutinin__InfluenzaB__ABL76331
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaagucgcuccggguucuuugcaaccauggccugggcuguuccaagagacaauaacaaaacggccacuaauccgcugacaaucgaggugccccacauuuguaccaaggaagaggaucagaucacugucuggggauuccauucugacaacaaaacacagaugaagaaucuguacggugauagcaacccucaaaaguuuaccuccucagcgaauggcgugacgacccacuaugugagucagauagggggauucccagaccagacagaggauggcggucucccccagagcgggaggauugucguugacuacauggugcaaaaaccuggaaagacuggcaccaucguauaucagcggggcauuuuacugccacagaaaguguggugcgcaucugggcgcuccaaggucaucaaaggaucacuucccuugaucggugaagccgauugucugcacgagaaguacggcgggcuaaacaaaagcaagccguauuacacaggagaacaugcuaaggccauuggcaacugcccuauaugggugaaaacuccccucaagcuggcaaaugguaccaaauaccgaccuccagcuaaacuucugaaggagagaggguuuuucggcgccaucgcgggauuuuuggagggcgggugggaaggaaugauugccgguuggcacggcuauacaagucauggggcacacggaguugcuguggccgcugaccucaagucuacccaggaggccaucaacaagauaacuaaaaaucugaacuccuuaagcgaacuggaggucaagaaucuccaaaggcuuucgggcgcaauggaugaacugcacaacgagauuuuggagcuagacgaaaaaguggacgaucugcgggccgacacgaucucuucccagaucgagcucgcuguacugcuuucaaaugaagguauuaucaacagugaggaugaacaucuguuggcgcucgagcguaagcugaaaaagauguuagggcccagcgcaguugacauuggcaauggauguuucgagacaaagcacaaaugcaaccagaccugccuggaucgcauagccgcuggcacuuuuaaugccggggaguucucccuaccaaccuuugacucucucaacaucacagcagccagccugaaugaugacggacuugauaaccauaccauuuugcuguacuauucaacugcugccaguucccucgcagugacacugaugaucgcgaucuucauugucuacaugauaagcagagacaaugugucuuguucaaucugccuuuga

SEQ ID NO: 148419 - RNA, 1755 nt, Artificial Sequence
  derived and/or modified sequence opt3 from hemagglutinin__InfluenzaB__ABL76342
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacagucgaggugccccacauuuguaccaaggaagaggaucagaucacuguguggggauuccauucugacaacaaaacacagaugaagaaucuguacggugauagcaacccucaaaaguuuaccuccucagcgaauggcgucacgacccacuauguuagucagauuggggacuucccagaucagacagaggacggaggccucccccagagcgguaggaucgugguagauuacauggugcaaaaaccugggaagacuggaaccauagucuaucagcggggcauuuuacugccacagaaaguguggugcgcaucuggccgcuccaagguuauccgagggucacuucccuugauuggagaagccgacugucugcacgagaaauacgguggccuaaacaagagcaaaccguauuacacaggggaacaugcuaaggccaucggaaacugcccuaucugggugaagacuccccucaaacuggcaaauggcaccaaguacagaccuccagcuaaacuucugaaggagaggggguuuuucggugccauugcgggcuuuuuggagggaggcugggaagggaugauagccggauggcacgguuauacaagucauggcgcacacggggucgcuguggccgcugaucucaaaucuacccaggaggccaucaacaagauuacuaagaaucugaacuccuuaagcgaacuggagguuaaaaaucuccaacggcuuucgggagcaauggacgaacugcacaacgagaucuuggagcuagacgaaaagguagaugaccugcgugccgauacgauaucuucccagauugagcucgcugugcugcuuucaaaugaaggcaucaucaacagugaggacgaacaucuguuggcgcucgagcgcaaacugaagaaaauguuaggucccagcgcagucgauauugggaauggcuguuucgagacaaagcacaagugcaaccagaccugccuggacagaaucgccgcuggaacuuuuaaugccggcgauuucucccuaccaaccuuugacucucucaacauuacagcagccagccugaaugaugacgggcuugauaaccauaccauauugcuguacuauucaacugcugccaguucccucgcagugacacugaugaucgcgauuuucaucgucuacaugaucagcagggacaaugugucuuguucaauuugccuuuga

SEQ ID NO: 148420 - RNA, 1755 nt, Artificial Sequence
  derived and/or modified sequence opt3 from hemagglutinin__InfluenzaB__ABL76353
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacagucgaggugccccacauuuguaccaaggaagaggaucagaucacuguguggggauuccauucugacaacaaaacacagaugaagaaucuguacggugauagcaacccucaaaaguuuaccuccucagcgaauggcgucacgacccacuauguuagucagauugggggauucccagaccagacagaggauggcggucucccccagagcgggaggaucgugguagacuacauggugcaaaaaccuggaaagacuggcaccauagucuaucagcggggcauuuuacugccacagaaaguguggugcgcaucugggcgcuccaagguuauccgaggaucacuucccuugauuggugaagccgauugucugcacgagaaauacggcgggcuaaacaagagcaaaccguauuacacaggagaacaugcuaaggccaucggcaacugcccuaucugggugaagacuccccucaaacuggcaaaugguaccaaguacagaccuccagcuaaacuucugaaggagaggggguuuuucggcgccauugcgggauuuuuggagggcgggugggaaggaaugauagccgguuggcacggcuauacaagucauggggcacacggagucgcuguggccgcugaccucaaaucuacccaggaggccaucaacaagauuacuaagaaucugaacuccuuaagcgaacuggagguuaaaaaucuccaacggcuuucgggcgcaauggaugaacugcacaacgagaucuuggagcuagacgaaaagguagacgaucugcgugccgacacgauaucuucccagauugagcucgcugugcugcuuucaaaugaagguaucaucaacagugaggaugaacaucuguuggcgcucgagcgcaaacugaagaaaauguuagggcccagcgcagucgacauuggcaauggauguuucgagacaaagcacaagugcaaccagaccugccuggauagaaucgccgcuggcacuuuuaaugccggggacuucucccuaccaaccuuugauucucucaacauuacagcagccagccugaaugacgauggacuugacaaccauaccauauugcuguacuauucaacugcugccaguucccucgcagugacacugaugaucgcgauuuucaucgucuacaugaucagcagggauaaugugucuuguucaauuugccuuuga

SEQ ID NO: 148421 - RNA, 1755 nt, Artificial Sequence
  derived and/or modified sequence opt3 from hemagglutinin__InfluenzaB__ABL76375
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccucagcaaauggcaucacgacccacuaugugagucagauagggggauucccagaccagacagaggauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaagcugauugucugcacgagaaauacggcgggcuaaacaagagcaagccguauuacacaggagaacaugccaaagcaauuggcaacugcccuauaugggucaagacuccccucaaacuggcuaaugguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaccucaagucuacccaggaggcaaucaacaaaauaacuaagaaucugaacuccuuaagcgaacuggaggugaaaaaucuccaaagacuuucgggcgccauggaugaacugcacaacgagauuuuggagcuagacgaaaaggucgacgaucugagggcugacacgaucucuucccagaucgagcucgcggugcugcuuucaaaugaagguauuaucaacagugaggaugaacaucuguuggcacucgagcggaaacugaagaagauguuagggcccagcgccguagacauuggcaauggauguuucgagacaaaacacaagugcaaccagaccugccuggaucguauagcugccggcacuuuuaaugcaggggaguucucccuaccaaccuuugacucucucaacaucacagccgcuagccugaaugaugacggacuugauaaccauaccauuuugcuguacuauucaacugccgcaaguucccucgcgguuacacugaugaucgcuaucuucauuguguacaugauaagccgcgacaaugucucuuguucaaucugccuuuga

SEQ ID NO: 148422 - RNA, 1755 nt, Artificial Sequence; identical to SEQ ID NO: 148421
  derived and/or modified sequence opt3 from hemagglutinin__InfluenzaB__ABL76386

SEQ ID NO: 148423 - RNA, 1755 nt, Artificial Sequence
  derived and/or modified sequence opt3 from hemagglutinin__InfluenzaB__ABL76408
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcguuggaaucacuccuagcgccaaggcauccauucuacacgaagugcgcccagucaccucuggcuguuuccccaucaugcaugaucgaacaaagauacgucaacucccuaaucugcuuagagguuacgagaaaaucaggcugucgacucagaacgugauugacgccgaaaaggcuccagggggacccuaucgguugggcaccucaggcagcugcccuaaugcaacaaguaaauccggguuuuucgccaccauggcuugggccguaccacgcggaaacaauaagacggcgacuaacccgcucacaguugaggugccccacaucuguaccaaagaagaggaucagauuacugucugggguuuucauucugacaauaagacacagaugaagaaccuguacggcgauagcaauccucaaaaauucaccuccucagcaaacgggaucacgacccacuaugugagucagauaggaggcuuuccagaccagacagaggauggugggcugccccagagcggaagaauuguggucgacuacaugguucaaaagccuggcaaaacuggcaccaucguguaucagagggggauucucuuaccacagaagguauggugcgccucuggacgguccaaagugaucaaggguucacugccccuuaucggcgaagcugauuguuugcacgagaaauacgggggacugaauaagagcaagccguauuacacaggcgaacaugccaaagcaauugguaacugcccuauaugggucaagacuccccuaaaacucgcuaacgggaccaaguaccgcccuccagccaaacugcuuaaggagcgaggcuucuuuggagcgaucgccggcuuccuggaagggggaugggaggguaugauugcaggcuggcacggguauacaagucauggagcucacggcguggccguugcugccgacuugaagucuacccaggaggcaaucaauaaaauaacuaagaaccucaauucccugagcgaauuagaggugaaaaaccugcaaagacucucgggugccauggaugaacuucacaaugagauucuggaguuggacgaaaaggucgacgaucuaagggcugacacgaucucuucccagaucgagcuggcggugcuccugucaaacgaagggauuaucaauagugaggaugaacaucuucuggcauuggagcggaaacucaagaagaugcugggccccagcgccguagacauuggaaacggcuguuuugagacaaaacacaagugcaaucagaccugcuuagaucguauagcugccgggacuuucaacgcaggagaauuuucccugccaaccuucgacucucuaaauaucacagccgcuagccucaacgaugacggucuggauaaucauaccauucuuuuguacuauucaacugccgcaaguucccuggcgguuacacucaugaucgcuaucuucauuguguacaugauaagccgcgacaacgucucuuguucaaucugccuguga

SEQ ID NO: 148424 - RNA, 1755 nt, Artificial Sequence
  derived and/or modified sequence opt3 from hemagglutinin__InfluenzaB__ABL76419
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcguuggaaucacuccuagcgccaaggcauccauucuacacgaaauccgcccagugaccucuggcuguuuccccauaaugcaugaucgaacaaagauccgucaacucccuaaucugcuuagagguuacgagaaaauuaggcugucgacucagaacgucaucgacgccgaaaaggcuccagggggacccuaucgguugggcaccucaggcagcugcccuaaugcaacaaguaaauccggguuuuucgccaccauggcuugggccgugccacgcggaaacaauaagacggcgacuaacccgcucacaguagagguuccccacauuuguaccaaagaagaggaucagaucacugugugggguuuucauucugacaauaagacacagaugaagaaccuguacggcgauagcaauccucaaaaauucaccuccucagcaaacgggauaacgacccacuaugucagucagauuggaggcuuuccagaccagacagaggauggugggcugccccagagcggaagaaucgugguggacuacaugguccaaaagccuggcaaaacuggcaccauuguuuaucagagggggauccucuuaccacagaagguguggugcgccucuggacgguccaaaguaaucaaggguucacugccccuuauuggcgaagcugauuguuugcacgagaaauacgggggacugaauaagagcaagccguauuacacaggcgaacaugccaaagcaauagguaacugcccuaucugggugaagacuccccuaaaacucgcuaacgggaccaaguaccgcccuccagccaaacugcuuaaggagcgaggcuucuuuggagcgauugccggcuuccuggaagggggaugggaggguaugaucgcaggcuggcacggguauacaagucauggagcucacggcgucgccguggcugccgacuugaagucuacccaggaggcaauaaauaaaauuacuaagaaccucaauucccugagcgaauuagagguuaaaaaccugcaaagacucucgggugccauggaugaacuucacaaugagauccuggaguuggacgaaaagguggacgaucuaagggcugacacgaucucuucccagauugagcuggcgguccuccugucaaacgaagggaucauuaauagugaggaugaacaucuucuggcauuggagcggaaacucaagaagaugcugggccccagcgccguggacauaggaaacggcuguuuugagacaaaacacaagugcaaucagaccugcuuagaucguaucgcugccgggacuuucaacgcaggagaauuuucccugccaaccuucgacucucuaaauauuacagccgcuagccucaacgaugacggucuggauaaucauaccauccuuuuguacuauucaacugccgcaaguucccuggcgguaacacucaugaucgcuauuuucauaguuuacaugaucagccgcgacaacgugucuuguucaauuugccuguga

SEQ ID NO: 148425 - RNA, 1758 nt, Artificial Sequence
  derived and/or modified sequence opt3 from hemagglutinin__InfluenzaB__ABL76441
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagcccgggacaauuacuuaccaacgcggaauccucuuaccucagaaaguguggugcgcgucugguagauccaaggucaucaaaggcucacugccacuuauuggggaggcagacuguuugcaugaaaaguauggaggccugaacaagagcaaacccuacuacaccggugagcacgccaaggcuauagggaauugcccgaucugggugaaaacaccucuaaagcucgccaacggcacuaaauauaggcccccagcaaagcugcuuaaggagcggggauuuuucggcgcuauugccggguuucuggaaggagguugggagggcaugaucgcgggguggcauggauacaccagucacggcgcccacgguguugcaguggcugccgauuugaaaucuacacaggaagcuauaaauaagauuaccaaaaaccucaauucccugagcgaguuagaagucaagaaccugcagcgccucucgggggccauggacgagcuucauaaugagauccuggaauuggaugagaaaguggacgaccuacgagcagauacuaucucuucccaaauugaacuggccguacuccugucaaacgagggcaucauuaauagugaagacgagcaccuucuggcuuuggagagaaagcucaagaaaaugcugggaccuagcgcgguugaaauaggcaacggguguuucgagacgaagcauaaaugcaaucagacaugcuuagauaggaucgcagccggaaccuuugacgcuggugaguucucccugcccacuuuugauucucuaaacauuaccgccgcaagccucaaugacgaugaacuggacaaccacacaauccuuuuguauuacucaaccgccgcuaguucccuggccgugacucucaugaucgcaauuuucgucguguauauggucagccgggauaacgugucuuguucaauaugccuguga

SEQ ID NO: 148426 - RNA, 1758 nt, Artificial Sequence
  derived and/or modified sequence opt3 from hemagglutinin__InfluenzaB__ABL76463
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguagauccaaggucaucaaaggcucacugccucuuauuggggaggcagacuguuugcaugaaaaguauggaggccugaacaagagcaaaccauacuacacaggugagcacgccaaggcuauagggaauugccccaucugggugaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguugcaguggcugccgauuugaaaucuacccaggaagcuauaaauaagauuacuaaaaaccucaauucccugagcgaguuagaagucaagaaccugcagcgccucucgggggccauggacgagcuucauaaugagauccuggaauuggaugagaaagugaacgaccuacgagcagacacgaucucuucccaaauugaacuggccguacuccugucaaaugagggcaucauuaacagugaagaugagcaccuucuggcuuuggagagaaagcucaagaaaaugcugggaccaagcgcgguugaaauaggcaauggguguuucgagacaaagcauaaaugcaaccagaccugcuuagacaggaucgcagccggaacuuuugaugcuggugaguucucccugccuaccuuugacucucuaaauauuacagccgcaagccucaacgaugacggccuggauaaccacaccauccuuuuguauuacucaacugccgcuaguucccuggccgugacacucaugaucgcaauuuucgucguguauauggucagccgggacaaugugucuuguucaauaugccuguga

SEQ ID NO: 148427 - RNA, 1758 nt, Artificial Sequence
  derived and/or modified sequence opt3 from hemagglutinin__InfluenzaB__ABL76474
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguagauccaaggucaucaaaggcucacugccucuuauuggggaggcagacuguuugcaugaaaaguauggaggccugaacaagagcaaaccauacuacacaggugagcacgccaaggcuauagggaauugccccaucugggugaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguugcaguggcugccgauuugaaaucuacccaggaagcuauaaauaagauuacuaaaaaccucaauucccugagcgaguuagaagucaagaaccugcagcgccucucgggggccauggacgagcuucauaaugagauccuggaauuggaugagaaaguggacgaccuacgagcagauacgaucucuucccaaauugaacuggccguacuccugucaaacgagggcaucauuaauagugaagacgagcaccuucuggcuuuggagagaaagcucaagaaaaugcugggaccaagcgcgguugaaauaggcaacggguguuucgagacaaagcauaaaugcaaucagaccugcuuagauaggaucgcagccggaacuuuugacgcuggugaguucucccugccuaccuuugauucucuaaacauuacagccgcaagccucaaugacgaugaacuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 148428 - RNA, 1758 nt, Artificial Sequence
  derived and/or modified sequence opt3 from hemagglutinin__InfluenzaB__ABL76485
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugugacaauggccugggcugucccaaagaacgacaauaacaaaaccgcaacgaauagucucacuauugaagugccguacaucuguacagagggugaggaucagauaaccguguggggcuuccacuccgacaacgaaacucagauggccaagcuguauggggauucuaagccccagaaauuuacaagcuccgcuaacggagucaccacgcacuacguuucacaaauuggcgguuucccuaaucagaccgaggacgggggacugccacagaguggccggaucgugguagauuauauggugcaaaagagcggcaaaacagggacuauuaccuaccagcgcggaauccucuuaccccagaaggucuggugcgccucugguagauccaaagugaucaagggcucacugccucuuauuggggaagcggacuguuugcaugagaaauauggaggccugaacaagagcaagccauacuacacaggugagcacgcaaaagccauagggaauugccccaucuggguuaagacuccgcuaaaacucgcuaacggcaccaaguauaggccucccgccaaacugcuuaaggaacggggauuuuucggcgcaauugcuggguuucuggagggagguugggaaggcaugaucgccggguggcauggauacacaagucacggcgcgcacgguguggccgucgcagcugauuugaagucuacccaggaggccauaaauaaaauuacuaagaaccucaauucccugagcgaauuagaggugaaaaaccugcagcgccucucgggggcuauggacgagcuucauaaugaaauccuggaguuggaugaaaagguagacgaccuacgagccgauacgaucucuucccaaauugagcuggcaguucuccugucaaacgaaggcaucauuaauagugagaacgagcaccuucuggccuuggaaagaaaacucaagaagaugcugggaccaagcgcuguggagauaggcaauggguguuucgaaacaaaacauaagugcaaccagaccugcuuagacaggaucgcggcaggaacuuuugaugccggugaguucucccugccuaccuuugacucucuaaauauuacagcugccagccucaacgaugacggccuggauaaccacaccauccuuuuguauuacucaacugcagccaguucccuggcugucacacucaugaucgccauuuucguggucuauauggugagccgggacaauguuucuuguucaauaugccuguga

SEQ ID NO: 148429 - RNA, 1758 nt, Artificial Sequence
  derived and/or modified sequence opt3 from hemagglutinin__InfluenzaB__ABL76507
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaauucagauggcuaagcuguauggggauucuaagccccagaaauuuacuagcuccgccaacggagugacaacccacuacgucucacaaaucggcgguuucccuaaucagacggaggacgggggacugccacagaguggccggauuguuguggauuauaugguacaaaagagcggcaaaaccgggacaaucacuuaccagcgcggaauccucuuaccccagaagguguggugcgcgucugguagauccaaagucauuaagggcucacugccucuuauaggggaagcagacuguuugcaugagaaauauggaggccugaacaagagcaagccauacuacaccggugagcacgccaaagcuaucgggaauugccccauuugggugaagacaccgcuaaaacucgccaacggcacuaaguauaggccucccgcaaaacugcuuaaggaacggggauuuuucggcgcuaucgccggguuucuggagggagguugggaaggcaugauagcgggguggcauggauacaccagucacggcgcccacgguguugcaguggcugccgauuugaagucuacacaggaggcuauuaauaaaaucaccaagaaccucaauucccugagcgaauuagaggucaaaaaccugcagcgccucucgggggccauggacgagcuucauaaugaaauccuggaguuggaugaaaagguggacgaccuacgagcagauacuauuucuucccaaaucgagcuggccguacuccugucaaacgaaggcauuauaaauagugaggacgagcaccuucuggcuuuggaaagaaaacucaagaagaugcugggaccaagcgcgguugagaucggcaacggguguuucgaaacgaaacauaagugcaaucagacaugcuuagauaggauugcagccggaaccuuugacgcuggugaguucucccugccuacuuuugauucucuaaacaucaccgccgcaagccucaaugacgauggccuggacaaccacacaauccuuuuguauuacucaaccgccgcuaguucccuggccgugacucucaugauugcaauauucgucguguauauggucagccgggauaacgugucuuguucaaucugccuguga

SEQ ID NO: 148430 - RNA, 1758 nt, Artificial Sequence
  derived and/or modified sequence opt3 from hemagglutinin__InfluenzaB__ABL76518
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaaaccagauggcuaagcuguauggggauucuaagccccagaaauuuacuagcuccgccaauggagugacaacccacuacgucucacaaauuggcgguuucccuaaccagacggaggacgggggacugccacagaguggccggaucguuguggauuauaugguacaaaagagcggcaaaaccgggacaauuacuuaccagcgcggaauccucuuaccccagaagguguggugcgcgucugguagauccaaagucaucaagggcucacugccucuuauuggggaagcagacuguuugcaugagaaauauggaggccugaauaagagcaagccauacuacaccggugagcacgccaaagcuauagggaacugccccaucugggugaagacaccgcuaaaacucgccaauggcacuaaguauaggccucccgcaaaacugcuuaaggaacggggauuuuucggcgcuauugccggguuucuggagggagguugggaaggcaugaucgcgggguggcauggauacaccagucacggcgcccacgguguugcaguggcugccgauuugaagucuacacaggaggcuauaaacaaaauuaccaagaaucucaacucccugagcgaauuagaggucaaaaaucugcagcgccucucgggggccauggacgagcuucauaacgaaauccuggaguuggaugaaaagguggacgaccuacgagcagauacuaucucuucccaaauugagcuggccguacuccugucaaaugaaggcaucauuaacagugaggacgagcaccuucuggcuuuggaaagaaaacucaagaagaugcugggaccaagcgcgguugagauaggcaauggguguuucgaaacgaaacauaagugcaaccagacaugcuuagauaggaucgcagccggaaccuuugacgcuggugaguucucccugccuacuuuugauucucuaaauauuaccgccgcaagccucaacgacgauggccuggacaaccacacaauccuuuuguauuacucaaccgccgcuaguucccuggccgugacucucaugaucgcaauuuucgucguguauauggucagccgggauaaugugucuuguucaauaugccuguga

SEQ ID NO: 148431 - RNA, 1758 nt, Artificial Sequence
  derived and/or modified sequence opt3 from hemagglutinin__InfluenzaB__ABL76529
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugugacaauggccugggcugucccaaagaacgacaauaacaaaaccgcaacgaauagucucacuauugaagugccguacaucuguacagagggugaggaucagauaaccguguggggcuuccacuccgacaacgaaacucagauggccaagcuguauggggauucuaagccccagaaauuuacaagcuccgcuaacggagucaccacgcacuacguuucacaaauuggcgguuucccuaaucagaccgaggacgggggacugccacagaguggccggaucgugguagauuauauggugcaaaagagcggcaaaacagggacuauuaccuaccagcgcggaauccucuuaccccagaaggucuggugcgccucugguagauccaaagugaucaagggcucacugccucuuauuggggaagcggacuguuugcaugagaaauauggaggccugaacaagagcaagccauacuacacaggugagcacgcaaaagccauagggaauugccccaucuggguuaagacuccgcuaaaacucgcuaacggcaccaaguauaggccucccgccaaacugcuuaaggaacggggauuuuucggcgcaauugcuggguuucuggagggagguugggaaggcaugaucgccggguggcauggauacacaagucacggcgcgcacgguguggccgucgcagcugauuugaagucuacccaggaggccauaaauaaaauuacuaagaaccucaauucccugagcgaauuagaggugaaaaaccugcagcgccucucgggggcuauggacgagcuucauaaugaaauccuggaguuggaugaaaagguagacgaccuacgagccgauacgaucucuucccaaauugagcuggcaguucuccugucaaacgaaggcaucauuaauagugaggacgagcaccuucuggccuuggaaagaaaacucaagaagaugcugggaccaagcgcuguggagauaggcaacggguguuucgaaacaaaacauaagugcaaucagaccugcuuagauaggaucgcggcaggaacuuuugacgccggugaguucucccugccuaccuuugauucucuaaacauuacagcugccagccucaaugacgauggccuggacaaccacaccauccuuuuguauuacucaacugcagccaguucccuggcugucacacucaugaucgccauuuucguggucuauauggugagccgggauaacguuucuuguucaauaugccuguga

SEQ ID NO: 148432 - RNA, 1758 nt, Artificial Sequence
  derived and/or modified sequence opt3 from hemagglutinin__InfluenzaB__ABL76540
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgaggucaaaccagugacuucuggcuguuuucccaucaugcaugaucgcaccaagauacgacaacugccuaaccuucugcgugguuacgaacacaucagauugucgacacauaauguaauuaacgccgagaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaagucccauacaucuguacagagggugaggaucagauaaccguguggggcuuccacuccgacaacgaaacucagauggcuaagcuguauggggauucuaaaccccagaaguuuacaagcuccgccaacggagugaccacgcacuacgucucacaaauuggcgguuucccuaaucagaccgaggacgggggacugccacagaguggcaggaucguuguggauuauaugguacagaaaagcggcaagacagggacuauuaccuaccaacggggaauccucuuaccccagaaaguguggugcgcgucuggucgcuccaaggucaucaaaggcucacugccucuuauuggggaagcagacuguuugcaugagaaguauggaggccugaacaagagcaaaccauacuacacaggugagcacgccaaggcuauagggaauugccccaucugggugaaaacuccgcuaaagcucgccaacggcaccaaauauagaccucccgcaaagcugcuuaaggaaaggggauuuuucggcgcuauugccggguuucuggagggagguugggaaggcaugaucgcgggguggcauggauacacaagucacggcgcccacgguguugcaguggcugccgauuugaaaucuacccaggaggcuauaaauaagauuacuaaaaaccucaauucccugagcgaauuagaggucaagaaccugcagcggcucucgggggccauggacgagcuucauaaugaaauccuggaguuggaugaaaaaguggacgaccuacgcgcagauacgaucucuucccaaauugagcuggccguacuccugucaaacgaaggcaucauuaauagugaggacgagcaccuucuggcuuuggaacgaaagcucaagaaaaugcugggaccaagcgcgguugagauaggcaacggguguuucgaaacaaagcauaaaugcaaucagaccugcuuagauagaaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagcagggauaacgugucuuguucaauaugccuguga

SEQ ID NO: 148433 - RNA, 1758 nt, Artificial Sequence
  derived and/or modified sequence opt3 from hemagglutinin__InfluenzaB__ABL76551
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugauggcaaucuucgucguguauauggucagccgggauaacgugucuuguucaauuugccuguga

SEQ ID NO: 148434 - RNA, 1758 nt, Artificial Sequence
  derived and/or modified sequence opt3 from hemagglutinin__InfluenzaB__ABL76562
augaaggccaucauugugcugcucauggucguuaccagcaacgcugacagaauaugcacaaggaucacuuccucuaauucaccccacgugguaaaaacggcaacccagggcgaggugaacgucacaggggugauuccucuuacuaccacaccaaccaagagucauuucgccaaucugaaaggaacuaagacacgggguaaauuguguccgaagugcuuaaacuguaccgaucuggacguugcgcuaggccgccccaagugcacggggaauaucccuagcgcugaaguguccauucuccacgagguccgaccagugacuucuggauguuuucccaucaugcaugaucguaccaaaauaagacaacugccuaaccuucugaggggcuacgaacacauccgguugucgacacauaauguaauuaacgccgagaaggcaccaggugggcccuauaaaaucggaacuucaggcagcugcccuaauguuaccaacggcaauggguucuuugccacaauggcuugggcagugccaaagaacgacaauaacaaaaccgccacgaauagucucacuauugaagucccguacaucuguacagagggagaggaucagauaaccgugugggguuuccacuccgacaacgaaacucagauggcuaagcuguauggcgauucuaagccccagaaauuuacaagcuccgccaacggggugaccacgcacuacgucucacaaauuggaggcuucccuaaucagaccgaggacggugggcugccacagaguggacgcaucguuguggauuauaugguacaaaagagcggcaaaacaggcacuauuaccuaccagagagggauccucuuaccccagaagguguggugcgcgucuggaagguccaaagucaucaaggguucacugccucuuauuggcgaagcagacuguuugcaugagaaauaugggggacugaacaagagcaagccauacuacacaggcgagcacgccaaagcuauagguaauugccccaucugggugaagacuccgcuaaaacucgccaacgggaccaaguaucggccucccgcaaaacugcuuaaggaacgcggcuuuuucggagcuauugccggcuuucuggaagggggaugggaggguaugaucgcgggcuggcauggguacacaagucacggagcccacggcguugcaguggcugccgauuugaagucuacccaggaggcuauaaauaaaauuacuaagaaccucaauucccugagcgaauuagaggucaaaaaccugcagcgacucucgggugccauggacgagcuucauaaugaaauccuggaguuggaugaaaagguggacgaccuaagagcagauacgaucucuucccaaauugagcuggccguacuccugucaaacgaagggaucauuaauagugaggacgagcaccuucuggcuuuggaaaggaaacucaagaagaugcugggcccaagcgcgguugagauaggaaacggcuguuucgaaacaaaacauaagugcaaucagaccugcuuagaucggaucgcagccgggacuuuugacgugggagaguucucccugccuaccuuugauucucuaaacauuacagcugccagccucaaugacgauggucuggacaaccacaccauccuuuuguauuacucaacugcagccaguucccuggcugucacacucaugaucgccauuuucguggucuauauggugagccgugauaacguuucuuguucaauaugccuguga

SEQ ID NO: 148435 - RNA, 1758 nt, Artificial Sequence
  derived and/or modified sequence opt3 from hemagglutinin__InfluenzaB__ABL76573
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 148436 - RNA, 1758 nt, Artificial Sequence; identical to SEQ ID NO: 148435
  derived and/or modified sequence opt3 from hemagglutinin__InfluenzaB__ABL76584

SEQ ID NO: 148437 - RNA, 1758 nt, Artificial Sequence; identical to SEQ ID NO: 148435
  derived and/or modified sequence opt3 from hemagglutinin__InfluenzaB__ABL76595

SEQ ID NO: 148438 - RNA, 1758 nt, Artificial Sequence; identical to SEQ ID NO: 148435
  derived and/or modified sequence opt3 from hemagglutinin__InfluenzaB__ABL76606

SEQ ID NO: 148439 - RNA, 1758 nt, Artificial Sequence
  derived and/or modified sequence opt3 from hemagglutinin__InfluenzaB__ABL76617
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 148440 - RNA, 1755 nt, Artificial Sequence
  derived and/or modified sequence opt3 from hemagglutinin__InfluenzaB__ABL76628
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccgcauauuuguacagaaggagaggaucagaucaccgugugggguuuccacucugacaauaagacucagaugaaaaaccuguauggcgauagcaauccccaaaaguuuacauccucagcaaacggggugaccacgcauuacgucagucagauuggaggcuucccugaccagaccgaggauggugggcucccacagagcggaagaaucguuguggacuauaugaugcaaaagcccggcaaaacaggcacuauaguauaccagcgcgggguguuacugccucagaaggucuggugcgccucuggacgguccaaagugauuaaggguucacuuccauugaucggcgaagcugauugucugcacgagaaauaugggggacuaaacaagagcaaacccuacuacaccggcgaacacgccaaggcaauugguaauugcccgaucuggguuaagacaccucucaaacuggcuaacgggacuaaguauaggcccccagccaaacuucugaaggagcgaggcuuuuucggagcgaucgccggcuuuuuggaagggggaugggaagguaugauugcaggcuggcauggguacaccagucacggagcucauggcguggccgucgcugccgaccucaaaucuacacaggaggcaauaaauaagaucaccaagaacuuaaauucccugagcgaacuggaggugaaaaaccuccaaagacuuucgggugccauggacgaacugcacaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccuagcgccguggacaucggaaacggcuguuucgagacgaagcauaagugcaaucagacaugccuggaucguauugcugccgggaccuuuaacgcaggagaguucucccuacccacuuuugacucucucaauaucaccgccgcuagccugaacgaugacggucuugauaaucacacaauuuugcuguauuacucaaccgccgcaaguucccucgcggucacucugaugcuugcuauauucaucguguauauggucagccgcgacaacgugucuuguucaauuugccuguga

SEQ ID NO: 148441 - RNA, 1755 nt, Artificial Sequence
  derived and/or modified sequence opt3 from hemagglutinin__InfluenzaB__ABL76639
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaagccggcacaauaguauaucagcgcgggguguuacugccucagaaggucuggugcgcuucuggacgguccaaagugauuaaggguucacuuccauugaucggcgaagccgauugucugcaugagaaauacgggggacuaaacaagagcaaacccuacuauacuggcgaacacgcaaaggcuauugguaauugcccgaucuggguuaagaccccucucaaacuggccaacgggacaaaguacaggcccccagcgaaacuucugaaggagcgaggcuuuuucggagccaucgcaggcuuuuuggaagggggaugggaagguaugauugcuggcuggcacggguauacuucccauggagcccacggcguggcugucgccgcagaccucaaaucuacccaggaggccauaaauaagaucacaaagaaccugaauaguuuaagcgaacuggaggugaaaaaccuccaaagacuuucgggugcuauggacgaacugcauaaugagauuuuggagcuagaugaaaagguagacgaucugagggcggacaccaucucuucccagauagagcucgcaguucugcuuucaaacgaagggauuaucaauagugaggaugaacaccuguuggcccucgagcggaaacugaagaaaauguuaggcccuagcgcuguggacaucggaaacggcuguuucgagacuaagcacaagugcaaucagacgugccuggaucguauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgcgacaacgugucuuguucaauuugccuguga

SEQ ID NO: 148442 - RNA, 1755 nt, Artificial Sequence
  derived and/or modified sequence opt3 from hemagglutinin__InfluenzaB__ABL76683
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagcgcgggguguuacugccucagaaggucuggugcgccucuggacgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucucaaacuggcuaacgggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaagaacuuaaauucccugagcgaacuggaggugaaaaaccuccaaagacuuucgggugccauggacgaacugcauaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccuagcgccguggacaucggaaacggcuguuucgagacgaagcacaagugcaaucagacaugccuggaucguauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagccgcgacaacgugucuuguucaauuugccuguga

SEQ ID NO: 148443 - RNA, 1752 nt, Artificial Sequence
  derived and/or modified sequence opt3 from hemagglutinin__InfluenzaB__ABL76694
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaacgggccccagggggacccuaucgccucggcaccucaggcagcugcccuaacguuacaaguagagacggguucuuugcuaccauggcaugggccgugccaagggauaauaaaacggcuacuaacccgcugacagucgaggugcccuacauuuguaccaagggagaagaccagaucacugugugggguuuccacuccgauaauaaaacacagaugaagaaccuguauggcgacucuaauccucaaaaauuuaccagcuccgccaacggggucacgacccauuacguuucacagauuggaggcuucccaaaccagacagaggauggugggcucccccagaguggacggaucgugguagacuauauggugcaaaagccuggcaagacuggcaccauagucuaccagcgcgggguguuacugccacagaaaguuuggugcgcgagcggacgaucuaaggugauuaaagguucccuucccuugaucggcgaggcagauugucugcacgaaaaguaugggggacuaaauaaaucaaagccguacuacacaggcgagcacgccaaagcuauugguaacugcccuaucugggucaagacuccccucaagcuggccaaugggaccaaauauagaccuccagcaaaacuucugaaggaaaggggcuuuuucggagcuaucgccggcuuuuuggaagggggaugggaggguaugauugcgggcuggcauggguacacaagccacggagcccauggcguggcaguagcugccgaccucaagaguacccaggaggcuauaaacaaaaucacuaagaaucugaacucuuuauccgagcuggaaguuaagaaucuccaacggcuuagcggugccauggaugagcugcacaacgaaauuuuggagcuagacgagaaaguggacgaucugcgugcagacacgaucucgucucagauagaacucgccguccugcuuuccaaugaggggauuaucaacucagaagaugagcaccuguuggcucucgaacgcaagcugaaaaagauguuaggccccagugcgguggacaucggaaauggcuguuucgagacaaaacauaagugcaaccagaccugccuggauagaauugcagccgggacuuuuaaugcuggagaguucagccuaccaaccuuugacucccucaacaucacagccgcaucucugaaugaugacggucuugauaaccacaccauuuugcuguauuacagcacugccgcuucaagucucgccgucacacugaugauagcaaucuucauuguguauaugguuuccagggacaacgugagcuguucuaucugccuuuga

SEQ ID NO: 148444 - RNA, 1758 nt, Artificial Sequence
  derived and/or modified sequence opt3 from hemagglutinin__InfluenzaB__ABL76716
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucguuaauggcaccaaguaucggccucccgccaaacugcuuaaggaacgcggauuuuucggcgcaauugcuggguuucuggagggagguugggaaggcaugaucgccggguggcauggauacacaagucacggcgcgcacgguguggccgucgcagcugauuugaaaucuacccaggaggccauaaacaagauuacuaagaaucucaacucccugagcgaauuagaggugaaaaaucugcagcgacucucgggggcuauggacgagcuucauaacgaaauccuggaguuggaugaaaagguagacgaccuaagagccgauacgaucucuucccaaauugagcuggcaguucuccugucaaaugaaggcaucauuaacagugaggacgagcaccuucuggccuuggaaaggaaacucaagaaaaugcugggaccaagcgcuguggagauaggcaauggguguuucgaaacaaagcauaagugcaaccagaccugcuuagaucggaucgcggcaggaacuuuugacgccggugaguucucccugccuaccuuugauucucuaaauauuacagcugccagccucaacgacgauggccuggacaaccacaccauccuuuuguauuacucaacugcagccaguucccuggcugucacacucaugaucgccauuuucguggucuauauggugagccgugauaauguuucuuguucaauaugccuguga

SEQ ID NO: 148445 - RNA, 1755 nt, Artificial Sequence
  derived and/or modified sequence opt3 from hemagglutinin__InfluenzaB__ABL76760
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacaauugaggucccccacaucuguaccaaggaagaggaucagauuacuguguggggauuccauucugacaacaaaacacagaugaagaaucuguacggugauagcaacccucaaaaguuuaccuccucagcgaauggcgugacgacccacuaugucagucagaucgggggauucccagaccagacagaggauggcggucucccccagagcgggaggauaguuguggacuacaugguacaaaaaccuggaaagacuggcaccauuguguaucagcggggcaucuuacugccacagaaagucuggugcgcaucugggcgcuccaaggugauuaaaggaucacuucccuugaucggugaagccgauugucugcacgagaaguacggcgggcuaaacaaaagcaagccguauuacacaggagaacaugcuaaggccaucggcaacugcccuauuuggguuaaaacuccccucaagcuggcaaaugguaccaaauaccgaccuccagcuaaacuucugaaggagagaggguuuuucggcgccauagcgggauuuuuggagggcgggugggaaggaaugaucgccgguuggcacggcuauacaagucauggggcacacggaguggcugucgccgcugaccucaagucuacccaggaggccauuaacaagaucacuaaaaaucugaacuccuuaagcgaacuggaggugaagaaucuccaaaggcuuucgggcgcaauggaugaacugcacaacgagauauuggagcuagacgaaaaaguagacgaucugcgggccgacacgauuucuucccagaucgagcucgcuguucugcuuucaaaugaagguaucauuaacagugaggaugaacaucuguuggcgcucgagcguaagcugaaaaagauguuagggcccagcgcaguggacaucggcaauggauguuucgagacaaagcacaaaugcaaccagaccugccuggaucgcauugccgcuggcacuuuugacgccggggaguucucccuaccaaccuuugauucucucaauauaacagcagccagccugaacgacgauggacuugacaaucauaccaucuugcuguacuauucaacugcugccaguucccucgcagucacacugaugauugcgaucuucaucguguacaugauuagcagagauaacgucucuuguucaauaugccuuuga

SEQ ID NO: 148446 - RNA, 1755 nt, Artificial Sequence
  derived and/or modified sequence opt3 from hemagglutinin__InfluenzaB__ABL76771
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacaauugaggucccccacaucuguaccaaggaagaggaucagauuacuguguggggauuccauucugacgauaaaacacagaugaagaaccuguacggugacagcaauccucaaaaguuuaccuccucagcgaacggcgugacgacccacuaugucagucagaucgggggauucccagaucagacagaggacggcggucucccccagagcgggaggauaguuguggauuacaugguacaaaaaccuggaaagacuggcaccauuguguaucagcggggcaucuuacugccacagaaagucuggugcgcaucugggcgcuccaaggugauuaaaggaucacuucccuugaucggugaagccgacugucugcacgagaaguacggcgggcuaaauaaaagcaagccguauuacacaggagaacaugcuaaggccaucggcaacugcccuauuuggguuaaaacuccccucaagcuggcaaacgguaccaaauaccgaccuccagcuaagcugcugaaagagagaggguuuuucggcgccauagcgggauuuuuggagggcgggugggaaggaaugaucgccgguuggcacggcuauacaagucauggggcacacggaguggcugucgccgcugaucucaagucuacccaggaggccauuaauaagaucacuaaaaaccuuaauuccuuaagcgaacuggaggugaagaaccuccaaaggcuuucgggcgcaauggacgaacugcacaaugagauauuggagcuagacgaaaaaguagaugaccugcgggccgauacgauuucuucccagaucgagcucgcuguucugcuuucaaacgaagguaucauuaauagugaggacgaacaucuguuggcgcucgagcguaagcugaaaaagaucuuagggcccagcgcaguggauauuggcaacggauguuucgagacaaagcacaaaugcaaucagaccugccuggaccgcauagccgcuggcacuuuugaugccggggaguucucccuaccaaccuuugacucucucaacaucacagcagccagccugaaugaugacggacuugauaaccauaccauuuugcuguacuauucaacugcugccaguucccucgcagucacacugaugaucgcgaucuucauuguguacaugauaagcagagacaaugucucuuguucaaucugccuuuga

SEQ ID NO: 148447 - RNA, 1755 nt, Artificial Sequence
  derived and/or modified sequence opt3 from hemagglutinin__InfluenzaB__ABL76782
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggagccccaugugcgugggaaucacuccuuccgcuaaggccucuauucuccacgaaguccggccagugaccucgggcuguuuucccaucaugcaugaucgcacaaagauacgacaacugccuaaucuucugcgugguuacgagaaaaucagauugucaacucagaacguaauuaauaucgaaaaggcaccagggggacccuauaggcucggcaccagcggcaguugcccuaacgccacaucccggucuggguucuuugcuaccauggcaugggccguuccacgcgacaauaacaaaacggcuacuaauccgcugacaguggaggucccccacauuuguaccaaggaagaggaucagaucacuguguggggauuccauagcgacaacaaagcccagaugaagaaucuguacggugauuccaacccucaaaaguuuacaucaagugcgaauggcgugaccacgcacuaugucagccagauagggggauucccagaccagaccgaggauggcggucucccccagucugggagaauuguuguggacuacaugguacaaaaaccuggaaagacaggcacuaucguguaucagaggggcauuuuacugccacagaaagucuggugcgcauccgggcggucaaaggugaucaaaggaagccuucccuugaucggugaagccgauugucugcacgagaaguacggcgggcuaaacaaaaguaagccguauuacaccggagaacaugcuaaggccauuggcaacugcccuauauggguuaaaacaccccucaagcuggcaaaugguacuaaauaccgcccuccagcuaaacuucugaaggagcgaggguuuuucggcgccaucgcgggauuuuuggagggcgggugggaaggaaugauugccgguuggcacggcuauaccucucauggggcacacggaguggcugucgccgcugaccucaaguccacacaggaggccaucaacaagauaaccaaaaaucugaacagcuuaucggaacuggaggugaagaaucuccaaagacuuucuggcgcaauggaugaacugcacaacgagauuuuggagcuagacgaaaaaguagacgaucugagggccgacacuaucuccucacagaucgagcucgcuguucugcuuaguaaugaagguauuaucaacagcgaggaugaacaucuguuggcgcucgagcggaagcugaaaaagauguuagggcccuccgcaguggacauuggcaauggauguuucgagacgaagcacaaaugcaaccagacaugccuggaucguauagccgcuggcaccuuuaaugccggggaguucucucuaccaacuuuugacagccucaacaucaccgcagccucacugaaugaugacggacuugauaaccauacaauuuugcuguacuauaguaccgcugccuccagccucgcagucacucugaugaucgcgaucuucauuguguacaugauaucucgcgacaaugucucauguaguaucugccuuuga

SEQ ID NO: 148448 - RNA, 1755 nt, Artificial Sequence; identical to SEQ ID NO: 148421
  derived and/or modified sequence opt3 from hemagglutinin__InfluenzaB__ABL76793

SEQ ID NO: 148449 - RNA, 1755 nt, Artificial Sequence; identical to SEQ ID NO: 148421
  derived and/or modified sequence opt3 from hemagglutinin__InfluenzaB__ABL76815

SEQ ID NO: 148450 - RNA, 1758 nt, Artificial Sequence
  derived and/or modified sequence opt3 from hemagglutinin__InfluenzaB__ABL76826
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccggaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 148451 - RNA, 1758 nt, Artificial Sequence
  derived and/or modified sequence opt3 from hemagglutinin__InfluenzaB__ABL76837
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaguacgucaacugccuaaccuucugagagguuacgaacacauaagguugucgacacauaauguuaucaacgccgagaaggcaccagggggacccuauaaaauuggcacuucaggcagcugcccuaaugugaccaacgggaauggauucuuugccacaauggcuugggcagucccaaagaacgacaauaacaaaaccgccacgaauagucucacuguggaagugccguacaucuguacagagggugaggaucagauuaccgucuggggcuuccacuccgacucugaaacucagauggcuaagcuguauggggauagcaagccccagaaauuuacauccucaaguaacggaguuaccacgcacuacgugagccaaaucggcgguuucccuaaccagaccgaggacgggggacugccacagucuggccggauaguaguggauuauaugguccagaaguccggcaaaacagggacuauuaccuaccaacgcggaauccucuuaccccagaagguguggugcgccucagguagaagcaaaguuauuaagggcagucugccucuuaucggggaagcggacuguuugcaugagagguauggaggccugaauaaaucuaagccauacuacacaggugagcacgcaaaggccaucgggaacugccccauuugggugaaaacuccgcuaaagcucgcuaauggcaccaaauaucggccucccgccaagcugcuuaaagaacgcggauuuuucggcgcaauagcuggguuucuggagggagguugggaaggcaugaucgccggguggcauggauacacaucccacggcgcgcacggugucgccguggcagcugaucucaagagcacccaggaggccauuaacaagaucacuaaaaauuugaacucgcugucugaauuagagguaaagaaucugcagcgacucuccggggcuauggacgagcuucauaacgaaauacuggaguuggaugaaaaaguugacgaccuaagagccgauacgauuucaagucaaaucgagcuggcagugcuccugagcaaugaaggcaucauuaacuccgaggacgagcaccuucuggccuuggaaaggaagcucaaaaagaugcugggaccaucugcugucgagaucggcaauggguguuucgaaacaaagcauaaaugcaaccagaccugcuuagaucggauugcggcaggaacuuuugacgccggugaguucagccugccuaccuuugauucacuaaauauaacagcugccagucucaacgacgauggccuggacaaucacaccauccuuuuguauuacuccacugcagccagcucucuggcugugacacucaugauugccaucuucgucguguauaugguuucacgugauaacgugaguuguagcaucugccuguga

SEQ ID NO: 148452 - RNA, 1755 nt, Artificial Sequence
  derived and/or modified sequence opt3 from hemagglutinin__InfluenzaB__ABL76848
augaaggccaucauugugcugcucauggucguuaccagcaacgcugacagaauaugcacaggcaucacuuccucuaauucaagucacgugguaaaaacggcaacccagggggaagugaacgucacaggagccauuccccuuacuaccacaccuaccaagagccauuucgcgaaucugaaagguacuaagacaaggggcaaauuguguccaaccugcuuaaacuguacggaucuggacguggcucuagggcggccgaugugcguuggaaucacucccccugccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccucagcaaauggcaucacgacccacuaugugagucagauagggggauucccagaccagacagaggauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaagcugauugucugcacgagaaauacggcgggcuaaacaagagcaagccguauuacacaggagaacaugccaaagcaauuggcaacugcccuauaugggucaagacuccccucaaacuggcuaaugguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaccucaagucuacccaggaggcaaucaacaaaauaacuaagaaucugaacuccuuaagcgaacuggaggugaaaaaucuccaaagacuuucgggcgccauggaugaacugcacaacgagauuuuggagcuagacgaaaaggucgacgaucugagggcugacacgaucucuucccagaucgagcucgcggugcugcuuucaaaugaagguauuaucaacagugaggaugaacaucuguuggcacucgagcggaaacugaagaagauguuagggcccagcgccguagacauuggcaauggauguuucgagacaaaacacaagugcaaccagaccugccuggaucguauagcugccggcacuuuuaaugcaggggaguucucccuaccaaccuuugacucucucaacaucacagccgcuagccugaaugaugacggacuugauaaccauaccauuuugcuguacuauucaacugccgcaaguucccucgcgguuacacugaugaucgcuaucuucauuguguacaugauaagccgcgacaaugucucuuguucaaucugccuuuga

SEQ ID NO: 148453 - RNA, 1755 nt, Artificial Sequence; identical to SEQ ID NO: 148421
  derived and/or modified sequence opt3 from hemagglutinin__InfluenzaB__ABL76859

SEQ ID NO: 148454 - RNA, 1755 nt, Artificial Sequence
  derived and/or modified sequence opt3 from hemagglutinin__InfluenzaB__ABL76881
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaggacacggggcaaguuguguccggauugcuuaaacuguaccgaccuggauguugcgcuagggcgccccaugugcgugggaacgacuccuagcgcuaaagccuccauccuccacgaaguccgaccagugaccucuggcuguuuucccauuaugcaugaccguacaaagaucagacaacugccuaaucuucugagggguuacgagaacauacgguugucgacucagaauguaaucgaugcagaaaaggccucagggggaccauaucgccucggcaccagcggcaguugccccaacgcuacauccaaaucuggguucuuugcaaccauggccugggcuguuccuaaggacaauaacaaaaaugccacgaacccacugacuguggaggucccguacauuuguacagaaggagaggaucagaucaccgugugggguuuccacagcgacaaugagacucagaugaagaaccuguauggcgauuccaauccccaaaaauuuacaucaagugcgaacggggugaccacgcauuacgucagccagauuggaggcuucccugaccagaaggaagauggugggcucccacagucuggaagaaucguuguggacuauaugguacaaaagcccggcaaaaccggcacaauaguguaccagcgcggggucuuacugccucagaagguguggugcgcauccggacggucaaaaguuauuaaggguagccuuccauugaucggcgaggccgauugucugcacgaaaaauaugggggacuaaacaagaguaaacccuacuacacuggcgagcacgcuaaggccauugguaauugcccgaucugggugaagaccccucucaaacuggcaaacgggacaaaguauaggcccccagcuaaacuucugaaggagcgaggcuuuuucggagccaucgcgggcuuuuuggaagggggaugggaggguaugauugccggcuggcauggguacacuucucacggagcacauggcgucgcuguggccgcugaccucaaauccacccaggaagccauaaauaagaucacaaagaaccugaauagcuuaucggagcuggaaguuaaaaaccuccaaagacuuucuggugcaauggacgagcugcacaaugagauuuuggaacuagaugagaagguagacgaucugagggccgacaccaucuccucacagauagaacucgcugugcugcuuaguaacgaggggauuaucaauagcgaagaugagcaccuguuggcgcucgagcggaaacugaagaaaauguuaggcccuuccgcagucgacaucggaaacggcuguuucgaaacuaagcauaagugcaaucagacgugccuggaucguauugccgcugggacauuuaacgccggagaguucucucuacccaccuuugacagccucaauaucacugcagccucacugaacgaugacggucuugauaaucacaccauuuugcuguauuacaguacagcugccuccagccucgcagugacccugaugcuugcgauauucaucgucuauauggugucucgcgacaacguuucauguaguauuugccuguga

SEQ ID NO: 148455 - RNA, 1755 nt, Artificial Sequence
  derived and/or modified sequence opt3 from hemagglutinin__InfluenzaB__ABL76892
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaggacacggggcaaguuguguccggauugcuuaaacuguaccgaccuggauguugcgcuagggcgccccaugugcgugggaacgacuccuagcgcuaaagccuccauccuccacgaaguccgaccagugaccucuggcuguuuucccauuaugcaugaccguacaaagaucagacaacugccuaaucuucugagggguuacgagaacauacgguugucgacucagaauguaaucgaugcagaaaaggccccagggggacccuaucgccucggcaccucaggcagcugcccuaacgcuacaaguaaauccggguucuuugcaaccauggccugggcuguuccaaaggacaauaacaaaaaugccacgaacccgcugacuguggagguccccuacguguguacagaaggagaggaucagauuaccgugugggguuuccacucugacaauaagacucagaugaaaaaccuguauggcgauagcaauccucaaaaguuuacauccucagcgaacggggucaccacgcauuacguuagucagaucggaggcuucccagaccagaccgaggauggugggcucccccagagcggaagaauugugguagacuauauggugcaaaagccuggcaaaacaggcacuaucgucuaccagaggggaguguuacugccacagaagguuuggugcgcaucugggcgguccaaagugauaaaggguucacuucccuugauuggcgaagccgauugucugcacgagaaauaugggggacuaaacaagagcaaaccguacuacaccggcgaacacgcuaaggccaucgguaauugcccuauuugggucaagacaccccucaaacuggcaaacgggacuaaguaucgcccuccagcuaaacuucugaaggagcgaggcuuuuucggagccaucgcgggcuuuuuggaagggggaugggaagguaugaucgccggcuggcauggguacaccagucacggagcacauggcguggcuguagccgcugaccucaaaucuacacaggaggccauuaauaagauaaccaagaacuuaaauucccugagcgaacuggagguuaaaaaccuccaaagacuuucgggugcaauggacgaacugcacaaugagaucuuggagcuagaugaaaagguggacgaucugagggccgacacuauuucuucccagaucgagcucgcuguccugcuuucaaacgaagggauaauuaauagugaggaugaacaccuguuggcgcucgagcggaaacugaagaaaauguuaggccccagcgcaguggacaucggaaacggcuguuucgagacgaagcauaagugcaaucagacaugccuggaucguaucgccgcugggaccuuuaacgccggagaguucucccuaccaacuuuugacucucucaauauuaccgcagccagccugaacgaugacggucuugauaaucacacaaucuugcuguauuacucaaccgcugccaguucccucgcagucacucugaugcuugcgauuuucauaguguauaugguuagccgcgacaacgugucuuguucaaucugccuguga

SEQ ID NO: 148456 - RNA, 1755 nt, Artificial Sequence
  derived and/or modified sequence opt3 from hemagglutinin__InfluenzaB__ABL76903
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagucaguaaucgaugcagaaaaggccccagggggacccuaccgccucggcaccagcggcaguugcccuaaugcuacauccaaaucuggguucuuugcaaccauggccugggcuguuccaaaggacaacaauaaaaacgccacgaauccgcugacuguggagguccccuauauuuguacagaaggagaggaucagaucaccgugugggguuuccauagcgacgauaagacucagaugaaaaaccuguacggcgacuccaauccucaaaaguuuacaucaagugcgaacggggugaccacgcacuaugucagccagauuggaggcuucccagaucagaccgaggacggugggcucccccagucuggaagaaucguuguggauuacaugauacaaaagccuggcaaaacaggcacuauuguauaucagaggggaguguuacugccacagaaggucuggugcgcauccgggcggucaaaagugaucaaggguagccuucccuugauuggcgaagccgacugucugcaugagaaauacgggggacuaaauaagaguaaaccguacuauaccggcgaacacgcuaaggccaucgguaacugcccuaucuggguuaagacaccccucaaacuggcaaacgggacuaaguaccgcccuccagcuaaacuucugaaggagcgaggcuuuuucggagccauugcgggcuuuuuggaagggggaugggaagguaugauagccggcuggcacggguauaccucucauggagcacacggcguggcugucgccgcugaccucaaauccacacaggaggccaucaauaagauuaccaagaaccugaauagcuuaucggaacuggaggugaaaaaccuccaaagacuuucuggugcaauggaugaacugcauaaugagaucuuggagcuagacgaaaagguagaugaccugagggccgauacuauauccgcucagauugagcucgcgguucugcuuucaaacgaagggaucaucaauagugaggacgaacaccuguuggcacucgagcggaaacugaagaaaauguuaggccccagcgccguggauauuggaaacggcuguuucgagacgaagcacaagugcaaucagacaugccuggaccguaucgcugccgggaccuuuaacgcaggagaguucucccuaccaacuuuugauucucucaauauuaccgccgcuagccugaacgacgauggucuugacaaucauacaauauugcuguacuauucaaccgccgcaaguucccucgcggucacucugaugcuugcuaucuucauuguguacauggucagccgcgacaacgugucuuguucaaucugccuguga

SEQ ID NO: 148457 - RNA, 1758 nt, Artificial Sequence
  derived and/or modified sequence opt3 from hemagglutinin__InfluenzaB__ABL76914
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaagcucagauggccaagcuguauggggauucuaagccccagaaauuuacuagcuccucaaacggagugacaacccacuacgucagucaaauuggcgguuucccuaaucagacggaggacgggggacugccacagagcggccggaucguuguggauuauaugguacagaagucuggcaaaaccgggacaauuacuuaccaacgcggaauccucuuaccccagaagguguggugcgcguccgguagaucaaaagucaucaagggcagccugccucuuauuggggaagcagacuguuugcaugagagguauggaggccugaacaaaaguaagccauacuacaccggugagcacgccaaggcuauagggaauugccccaucugggugaaaacaccgcuaaagcucgccaacggcacuaaauaucggccucccgcaaagcugcuuaaagaacgcggauuuuucggcgcuauugccggguuucuggagggagguugggaaggcaugaucgcgggguggcauggauacaccucucacggcgcccacgguguugcaguggcugccgauuugaaguccacacaggaggcuauaaauaagauuaccaaaaaccucaauagccugucggaauuagaggucaagaaccugcagcgacucucuggggccauggacgagcuucauaaugaaauccuggaguuggaugaaaaaguggacgaccuaagagcagauacuaucuccucacaaauugagcuggccguacuccugaguaacgaaggcaucauuaauagcgaggacgagcaccuucuggcuuuggaaaggaagcucaaaaagaugcugggaccauccgcgguugagauaggcaacggguguuucgaaacgaagcauaaaugcaaucagacaugcuuagaucggaucgcagccggaaccuuugacgcuggugaguucucucugccuacuuuugauagccuaaacauuaccgccgcaucacucaaugacgauggccuggacaaccacacaauccuuuuguauuacaguaccgccgcuuccagccuggccgugacucucaugaucgcaauuuucgucguguauauggucucucgugauaacgugucauguaguauaugccuguga

SEQ ID NO: 148458 - RNA, 1755 nt, Artificial Sequence
  derived and/or modified sequence opt3 from hemagglutinin__InfluenzaB__ABL76936
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaacuaccccuagcgcuaaggccuccauccuccacgaaguccgcccagugacaucuggcuguuuucccauuaugcaugaucgaacuaagauccgucaacugccuaaucuucugagagguuacgagaaaauaagguugucgacccagaacguaaucaaugcagaaaaggccccagggggacccuaucggcucggcacaucaggcagcugcccuaacgcuaccagucgcuccggguucuuugcaacgauggccugggcuguuccaagagacaauaacaaaacugccacaaauccgcugaccguggagguccccuacauuuguacuaaggaagaggaucagaucacaguguggggauuccacucugacgauaaaacccagaugaagaaccuguauggugacagcaauccucaaaaguuuacguccucagcgaacggcgugaccacacauuacgucagucagauugggggauucccagaucagacugaggacggcggucucccccagagcgggaggaucguuguggauuauaugguacaaaaaccuggaaagaccggcacaauaguguaccagcggggcgucuuacugccacagaaaguguggugcgcaucugggcgcuccaagguuauuaaaggaucacuucccuugaucggugaagccgacugucugcacgagaaguauggcgggcuaaauaaaagcaagccguacuacacuggagaacacgcuaaggccauuggcaacugcccuaucugggugaaaaccccacucaagcuggcaaacgguacaaaauaucgacccccugcuaagcugcugaaagagagaggguuuuucggcgccaucgcgggauuuuuggagggcgggugggaaggaaugauugccgguuggcauggcuacaccagucacggggcacauggagucgcuguggccgcugaucucaagucuacucaggaggccauaaauaagaucacgaaaaaccuuaauuccuuaagcgaacuggagguaaagaaccuccaaaggcuuucgggcgcaauggacgaacugcacaaugagauuuuggagcuagacgaaaaaguugaugaccugcgggccgauacaaucucuucccagauagagcucgcugugcugcuuucaaacgaagguauuaucaauagugaggacgaacaccuguuggcgcucgagcguaagcugaaaaagauguuagggcccagcgcagucgauaucggcaacggauguuucgagaccaagcauaaaugcaaucagacuugccuggaccgcauugccgcuggcaccuuuaacgccggggaguucucccuaccaacauuugauucucucaauaucaccgcagccagccugaacgacgauggacuugacaaucacacuauuuugcuguauuacucaacagcugccaguucccucgcagugacgcugaugauagcgaucuucauugucuauauggugagcagagauaacguuucuuguucaaucugccuuuga

SEQ ID NO: 148459 - RNA, 1755 nt, Artificial Sequence
  derived and/or modified sequence opt3 from hemagglutinin__InfluenzaB__ABL76947
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaagucgcuccggguucuuugccaccauggcuugggccguaccaagagacaauaacaaaacggcgacuaauccgcugacaguugaggugccccacaucuguaccaaggaagaggaucagauuacugucuggggauuccauucugacgauaaaacacagaugaagaaccuguacggugacagcaauccucaaaaguuuaccuccucaacgaacggcaucaccacacacuaugugagucagauagggggauucccagaucagacugaggacggcggucucccccagagcgggaggauuguggucgauuacaugguucaaaaaccuggaaagaccggcacaaucguguaucagcggggcauuuuacugccacagaaaguauggugcgcaucugggcgcuccaaggugaucaaaggaucacuucccuugaucggugaagccgacugucugcacgagaaguacggcgggcuaaauaaaagcaagccguauuacacuggagaacaugcuaaggccauuggcaacugcccuauaugggucaaaaccccacucaagcuggcaaacgguacaaaauaccgacccccugcuaagcugcugaaagagagaggguuuuucggcgccaucgcgggauuuuuggagggcgggugggaaggaaugauugccgguuggcacggcuauaccagucauggggcacacggaguggcuguugccgcugaucucaagucuacucaggaggccaucaauaagauaacgaaaaaccuuaauuccuuaagcgaacuggaggugaagaaccuccaaaggcuuucgggcgcaauggacgaacugcacaaugagauuuuggagcuagacgaaaaagucgaugaccugcgggccgauacaaucucuucccagaucgagcucgcugugcugcuuucaaacgaagguauuaucaauagugaggacgaacaucuguuggcgcucgagcguaagcugaaaaagauguuagggcccagcgcaguagauauuggcaacggauguuucgagaccaagcacaaaugcaaucagacuugccuggaccgcauagccgcuggcaccuuuaacgccggggaguucucccuaccaacauuugauucucucaauaucaccgcagccagccugaacgacgauggacuugacaaucauacuauuuugcuguacuauucaacagcugccaguucccucgcaguuacgcugaugaucgcgaucuucauuguguacaugauaagcagagauaacgucucuuguucaaucugccuuuga

SEQ ID NO: 148460 - RNA, 1758 nt, Artificial Sequence
  derived and/or modified sequence opt3 from hemagglutinin__InfluenzaB__ABL76958
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgaggcucagauggccaagcuguauggggauucuaaaccccagaaguuuacuagcuccgcgaacggagugacaacccacuacgucucacaaauuggcgguuucccuaaucagacggaagacgggggacugccacagaguggccggaucguuguggauuauaugguacagaaaagcggcaagaccgggacaauuacuuaccaacgcggaauccucuuaccccagaaaguguggugcgcaucugguagauccaaggucaucaaaggcucacugccucuuauuggggaggccgacuguuugcaugaaaaguauggaggccugaacaagagcaaaccauacuacaccggugagcacgcuaaggccauagggaauugccccaucugggugaaaacaccgcuaaagcucgcaaacggcacuaaauauaggccucccgcuaagcugcuuaaggagcggggauuuuucggcgccauugcgggguuucuggaaggagguugggagggcaugaucgccggguggcauggauacaccagucacggcgcacacgguguugcuguggccgcugauuugaaaucuacacaggaagccauaaauaagauuaccaaaaaccucaauucccugagcgaguuagaagucaagaaccugcagcgccucucgggggcaauggacgagcuucauaaugagauccuggaauuggaugagaaaguggacgaccuacgagccgauacuaucucuucccaaauugaacuggcuguacuccugucaaacgagggcaucauuaauagugaagacgagcaccuucuggcguuggagagaaagcucaagaaaaugcugggaccaagcgcaguugaaauaggcaacggguguuucgagacgaagcauaaaugcaaucagacaugcuuagauaggaucgccgcuggaaccuuuaacgccggugaguucucccugccuacuuuugacucucuaaauauuaccgcagccagccucaacgaugacggccuggauaaccacacaauccuuuuguauuacucaaccgcugccaguucccuggcagugacucucaugaucgcgauuuucgucguguauauggucagccgggacaauauaucuuguucaaucugccuguga

SEQ ID NO: 148461 - RNA, 1758 nt, Artificial Sequence
  derived and/or modified sequence opt3 from hemagglutinin__InfluenzaB__ABL76969
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaggacacggggcaaguuguguccgaaaugcuuaaacuguaccgaucuggacguugcgcuagggcgccccaagugcacgggaaauaucccuagcgcuaagguguccauucuccacgaaguccgaccagugacuucuggcuguuuucccaucaugcaugaucguaccaaaauaagacaacugccuaaccuucugagggguuacgagcacauccgguugucgauucauaauguaaucaacgccgaaaaggcaccagggggacccuauaaaauuggcacaucaggcagcugcccuaauguuacuaacgggaauggauucuuugccaccauggcuugggcagugccaaagaacgacaauaacaaaacagccaccaauagucucacgaucgaggucccguacauauguacugaaggugaggaucagauuacaguguggggcuuccacuccgacaacgaggcucagauggccaagcuguauggggauucuaagccccagaaauuuaccagcuccgcgaacggagugacuacacacuacgucucacaaaucggcgguuucccuaaucagaccgaagacgggggacugccacagaguggccgcauuguuguggauuauaugguacagaagaguggcaaaacggggaccaucacauaccaaagaggaauccucuuaccccagaagguguggugcgcaucugguagguccaaagucauuaagggcucacugccucuuauaggggaggccgacuguuugcaugaaaaauauggaggccugaacaagagcaagccauacuacacuggugagcacgcuaaagccaucgggaauugccccauuugggugaagaccccgcuaaaacucgcaaacggcacaaaguaucggccucccgcuaaacugcuuaaggagcgcggauuuuucggcgccaucgcgggguuucuggaaggagguugggagggcaugauagccggguggcauggauacacuagccacggcgcacacgguguugcuguggccgcugauuugaagucuacccaggaagccauuaauaaaaucacaaagaaccucaauucccugagcgaguuagaagucaaaaaccugcagcgacucucgggggcaauggacgagcuucauaaugagauccuggaauuggaugagaagguggacgaccuaagagccgauaccauuucuucccaaaucgaacuggcuguacuccugucaaacgagggcauuauaaauagugaagacgagcaccuucuggcguuggagaggaaacucaagaagaugcugggaccaagcgcaguugaaaucggcaacggguguuucgagacuaaacauaagugcaaucagacgugcuuagaucggauugccgcuggaacauuugacgccggugaguucucccugccuaccuuugauucucuaaacaucacugcagccagccucaaugacgauggccuggacaaccacaccauccuuuuguauuacucaacagcugccaguucccuggcagugacccucaugauugcgauauucgucguguauauggucagccgugauaacgugucuuguucaaucugccuguga

SEQ ID NO: 148462 - RNA, 1755 nt, Artificial Sequence
  derived and/or modified sequence opt3 from hemagglutinin__InfluenzaB__ABL76980
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaaguaaauccggguucuuugcaaccauggccugggcuguuccacgcgacaauaacaagacggccacuaauccgcugacaguggagguccccuacaucuguaccaaagaagaggaucagauuacuguguggggauuccacucugacaacaagacacagaugaagaaucuguauggugauagcgacccucaaaaauuuaccuccucagcgaacggcgugacgacccauuacgucagucagaucgggggauucccagaucagacagaggacggcggucucccccagagcgggagaauaguuguggauuauaugguacaaaagccuggaaaaacuggcaccauuguguaccagaggggcaucuuacugccacagaaggucuggugcgcaucugggcgguccaaagugauuaagggaucacuucccuugaucggugaagccgacugucugcacgagaaauauggcgggcuaaauaagagcaagccguacuacacaggagaacacgcuaaagccaucggcaacugcccuauuuggguuaagacuccccucaaacuggcaaacgguaccaaguaucgcccuccagcuaaacuucugaaggagcgaggguuuuucggcgccauagcgggauuuuuggagggcgggugggaaggaaugaucgccgguuggcauggcuacacaagucacggggcacauggaguggcugucgccgcugaucucaagucuacccaggaggccauuaauaaaaucacuaagaacuuaaauucccugagcgaacuggaggugaaaaaccuccaaagacuuucgggcgcaauggacgaacugcacaaugagauauuggagcuagacgaaaagguagaugaccugagggccgauacgauuucuucccagaucgagcucgcuguucugcuuucaaacgaagguaucauuaauagugaggacgaacaccuguuggcgcucgagcggaaacugaagaagauguuagggcccagcgcaguggauaucggcaacggauguuucgagacaaaacauaagugcaaucagaccugccuggaccguauugccgcuggcacuuuuaacgccggggaguucucccuaccaaccuuugauucucucaauauaacagcagccagccugaacgacgauggacuugacaaucacaccaucuugcuguauuacucaacugcugccaguucccucgcagucacacugaugauugcgaucuucaucguguauaugauuagccgcgauaacgucucuuguucaauaugccuuuga

SEQ ID NO: 148463 - RNA, 1752 nt, Artificial Sequence
  derived and/or modified sequence opt3 from hemagglutinin__InfluenzaB__ABL76991
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaauuacgccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacaacaaaauacagaugaagaaucuguauggcgauagcaacccucagaaauuuacuuccucagccaaugggauuacaacccacuacgugagucaaaucggaggcuucccaaaccagacggaggacggugggcucccccagagcggacggauugucguugauuauauggugcagaagccuggcaagaccggcacaaucguauaccaacgcgggguguuacugccacagaaagucuggugcgcgucuggacgauccaaggugaucaaagguucacuucccuugauuggcgaggcagacugucugcaugaaaaguaugggggacuaaacaaaagcaagccguacuacacuggcgagcacgccaaagcuauagguaauugcccuaucuggguuaagacuccccucaagcuggccaacgggacaaaauauagaccuccagcaaagcugcugaaagaaaagggcuuuuucggagcuauugccggcuuuuuggaagggggaugggaggguaugaucgcgggcuggcauggguacaccagucacggagcccacggcguggcagucgcugccgaucucaaaucuacccaggaggcuauaaauaagauuacaaagaaccuuaauuccuuaagcgagcuggaagugaaaaaccuccagaggcuuucgggugccauggacgagcugcauaaugaaaucuuggagcuagaugagaagguagacgaccugcgggcagauaccaucucuucccaaauugaacucgccguucugcuuucaaacgaggggaucauuaauagugaagacgagcaccuguuggcucucgaacguaaacugaagaaaauguuaggccccagcgcgguggauauaggaaacggcuguuucgagacuaagcauaagugcaaucagacgugccuggaccgcaucgcagccgggacauuuaacgcuggagaguucucccuaccaaccuuugauucucucaauauuacugccgcaagccugaacgacgauggucuugacaaucacaccaucuugcuguauuacucaacagccgcuaguucccucgccgucacccugaugaucgcaauuuucauaguguauauggucagcagagauaacgugucuuguucaaucugccuuuga

SEQ ID NO: 148464 - RNA, 1755 nt, Artificial Sequence
  derived and/or modified sequence opt3 from hemagglutinin__InfluenzaB__ABL77002
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacaauugaggucccccacaucuguaccaaggaagaggaucagauuacuaucuggggauuccauucugacgauaaaacacagaugaagaaccuguacggugacagcaauccucaaaaguuuaccuccucagcgaacggcgugacgacccacuaugugagucagauagggggauucccagaucagacagaggacggcggucucccccagagcgggaggauugucguugauuacauggugcaaaaaccuggaaagacuggcaccaucguauaucagcggggcauuuuacugccacagaaaguguggugcgcaucugggcgcuccaaggucaucaaaggaucacuucccuugaucggugaagccgacugucugcacgagaaguacggcgggcuaaauaaaagcaagccguauuacacaggagaacaugcuaaggccauuggcaacugcccuauaugggugaaaacuccccucaagcuggcaaacgguaccaaauaccgaccuccagcuaagcugcugaaagagagaggguuuuucggcgccaucgcgggauuuuuggagggcgggugggaaggaaugauugccgguuggcacggcuauacaagucauggggcacacggaguugcuguggccgcugaucucaagucuacccaggaggccaucaauaagauaacuaaaaaccuuaauuccuuaagcgaacuggaggucaagaaccuccaaaggcuuucgggcgcaauggacgaacugcacaaugagauuuuggagcuagacgaaaaaguggaugaccugcgggccgauacgaucucuucccagaucgagcucgcuguacugcuuucaaacgaagguauuaucaauagugaggacgaacaucuguuggcgcucgagcguaagcugaaaaagauguuagggcccagcgcaguugauauuggcaacggauguuucgagacaaagcacaaaugcaaucagaccugccuggaccgcauagccgcuggcacuuuugaugccggggaguucucccuaccaaccuuugacucucucaacaucacagcagccagccugaaugaugacggacuugauaaccauaccauuuugcuguacuauucaacugcugccaguucccucgcagugacacugaugaucgcgaucuucauugucuacaugauaagcagagacaaugugucuuguucaaucugccuuuga

SEQ ID NO: 148465 - RNA, 1755 nt, Artificial Sequence
  derived and/or modified sequence opt3 from hemagglutinin__InfluenzaB__ABL77013
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaagacaaggggcaaauuguguccgaccugcuuaaacuguacggaucuggacguugcgcuagggcggcccaugugcgugggaaucacuccuagcgcuaaggccuccauucuccaugaaguccgcccagugaccucuggcuguuuucccaucaugcacgaucgaacaaagauacgucaacugccuaaucuucugagagguuaugagaaaaucagguugucgacucagaacguaauuaaugcagaaaaggccccagggggacccuaccggcucggcaccucaggcagcugcccuaacgcuacaaguaaauccggguucuuugcaaccauggccugggcuguuccacgcgacaauaacaagacggccacuaauccgcugacaguggagguccccuauaucuguaccaaagaagaggaucagauuacuguguggggauuccauucugacaacaagaaucagaugaagaaccuguacggugauagcgacccucaaaaauuuacauccucagcgaauggcgugaccacgcacuaugucagucagaucgggggauucccagaucagaccgaggacggcggucucccccagagcgggagaauaguuguggauuacaugguacaaaagccuggaaaaacaggcacuauuguguaucagaggggcaucuuacugccacagaaggucuggugcgcaucugggcgguccaaagugauuaagggaucacuucccuugaucggugaagccgacugucugcaugagaaauacggcgggcuaaacaagagcaagccguacuauaccggagaacacgcuaaagccaucggcaacugcccuauuuggguuaagacaccccucaaacuggcaaaugguacuaaguaccgcccuccagcuaaacuucugaaggagcgaggguuuuucggcgccauagcgggauuuuuggagggcgggugggaaggaaugaucgccgguuggcacggcuauaccagucauggggcacacggaguggcugucgccgcugaucucaagucuacacaggaggccauuaacaaaaucaccaagaaucugaacuccuuaagcgaacuggaggugaaaaaucuccaaagacuuucgggcgcaauggacgaacugcauaacgagauauuggagcuagacgaaaagguagaugaccugagggccgauacuauuucuucccagaucgagcucgcuguucugcuuucaaaugaagguaucauuaacagugaggacgaacaccuguuggcgcucgagcggaaacugaagaagauguuagggcccagcgcaguggauaucggcaauggauguuucgagacgaaacacaagugcaaccagacaugccuggaccguauugccgcuggcaccuuuaaugccggggaguucucccuaccaacuuuugauucucucaacauaaccgcagccagccugaaugacgauggacuugacaaccauacaaucuugcuguacuauucaaccgcugccaguucccucgcagucacucugaugauugcgaucuucaucguguacaugauuagccgcgauaaugucucuuguucaauaugccuuuga

SEQ ID NO: 148466 - RNA, 1755 nt, Artificial Sequence
  derived and/or modified sequence opt3 from hemagglutinin__InfluenzaB__ABL77024
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacgauaagacacagaugaagaaccuguacggugacagcaauccucaaaaauuuaccuccucagcaaacggcaucacgacccacuaugugagucagauagggggauucccagaucagacagaggacggcggucucccccagagcgggagaauuguggucgauuacaugguucaaaagccuggaaaaacuggcaccaucguguaucagaggggcauuuuacugccacagaagguauggugcgccucugggcgguccaaagugaucaagggaucacuucccuugaucggugaagcugacugucugcacgagaaauacggcgggcuaaauaagagcaagccguauuacacaggagaacaugccaaagcaauuggcaacugcccuauaugggucaagacuccccucaaacuggcuaacgguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaucucaagucuacccaggaggcaaucaauaaaauaacuaagaacuuaaauucccugagcgaacuggaggugaaaaaccuccaaagacuuucgggcgccauggacgaacugcacaaugagauuuuggagcuagacgaaaaggucgaugaccugagggcugauacgaucucuucccagaucgagcucgcggugcugcuuucaaacgaagguauuaucaauagugaggacgaacaucuguuggcacucgagcggaaacugaagaagauguuagggcccagcgccguagauauuggcaacggauguuucgagacaaaacacaagugcaaucagaccugccuggaccguauagcugccggcacuuuuaacgcaggggaguucucccuaccaaccuuugauucucucaauaucacagccgcuagccugaacgacgauggacuugacaaucauaccauuuugcuguacuauucaacugccgcaaguucccucgcgguuacacugaugaucgcuaucuucauuguguacaugauaagccgcgauaacgucucuuguucaaucugccuuuga

SEQ ID NO: 148467 - RNA, 1755 nt, Artificial Sequence
  derived and/or modified sequence opt3 from hemagglutinin__InfluenzaB__ABL77035
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaagucgcuccggguucuuugccaccauggcuugggccguaccaagagacaauaacaaaacggcgacuaauccgcugacaguugaggugccccacaucuguaccaaggaagaggaucagauuacugucuggggauuccauucugacgauaaaacacagaugaagaaccuguacggugacagcaauccucaaaaguuuaccuccucagcaaacggcgugacgacccacuaugugagucagaucgggggauucccagaucagacagaggacggcggucucccccagagcgggaggauagucguugauuacauggugcaaaaaccuggaaagacuggcaccauuguauaucagcggggcaucuuacugccacagaaaguguggugcgccucugggcgcuccaaggucauuaaaggaucacuucccuugaucggugaagcugacugucugcacgagaaguacggcgggcuaaauaaaagcaagccguauuacacaggagaacaugccaaggcaaucggcaacugcccuauuugggugaaaacuccccucaagcuggcuaacgguaccaaauaccgaccuccagccaagcugcugaaagagagaggguuuuucggcgcgauagccggauuuuuggagggcgggugggaaggaaugaucgcagguuggcacggcuauacaagucauggggcucacggaguugccguggcugccgaucucaagucuacccaggaggcaauuaauaagaucacuaaaaaccuuaauuccuuaagcgaacuggaggucaagaaccuccaaaggcuuucgggcgccauggacgaacugcacaaugagauauuggagcuagacgaaaaaguggaugaccugcgggcugauacgauuucuucccagaucgagcucgcgguacugcuuucaaacgaagguaucauuaauagugaggacgaacaucuguuggcacucgagcguaagcugaaaaagauguuagggcccagcgccguugauaucggcaacggauguuucgagacaaagcacaaaugcaaucagaccugccuggaccgcauugcugccggcacuuuuaacgcaggggaguucucccuaccaaccuuugauucucucaauauaacagccgcuagccugaacgacgauggacuugacaaucauaccaucuugcuguacuauucaacugccgcaaguucccucgcggugacacugaugauugcuaucuucaucgucuacaugauuagcagagauaacgugucuuguucaauaugccuuuga

SEQ ID NO: 148468 - RNA, 1755 nt, Artificial Sequence
  derived and/or modified sequence opt3 from hemagglutinin__InfluenzaB__ABL77046
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacgauaagacacagaugaagaaccuguacggugacagcaauccucaaaaauuuaccuccucagcaaacggcaucacgacccacuaugugagucagauagggggauucccagaucagacagaggacggcggucucccccagagcgggagaauuguggucgauuacaugguucaaaagccuggaaaaacuggcaccaucguguaucagaggggcauuuuacugccacagaagguauggugcgccucugggcgguccaaagugaucaagggaucacuucccuugaucggugaagcugacugucugcacgagaaauacggcgggcuaaauaagagcaagccguauuacacaggagaacaugccaaagcaauuggcaacugcccuauaugggucaagacuccccucaaacuggcuaacgguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaucucaagucuacccaggaggcaaucaauaaaauaacuaagaacuuaaauucccugagcgaacuggaggugaaaaaccuccaaagacuuucgggcgccauggacgaacugcacaaugagauuuuggagcuagacgaaaaggucgaugaccugagggcugauacgaucucuucccagaucgagcucgcggugcugcuuucaaacgaagguauuaucaauagugaggacgaacaucuguuggcacucgagcggaaacugaagaagauguuagggcccagcgccauugauauaggcaacggauguuucgagacaaaacacaagugcaaucagaccugccuggaccguaucgcugccggcacuuuuaacgcaggggaguucucccuaccaaccuuugauucucucaauauuacagccgcuagccugaacgacgauggacuugacaaucauaccaucuugcuguacuauucaacugccgcaaguucccucgcgguaacacugaugaucgcuauuuucauaguuuacaugaucagccgcgauaacgugucuuguucaauuugccuuuga

SEQ ID NO: 148469 - RNA, 1755 nt, Artificial Sequence
  derived and/or modified sequence opt3 from hemagglutinin__InfluenzaB__ABL77057
augaaggccaucauugugcugcucauggucguuaccagcaaagcugacagaauaugcacaggcaucacuuccucuaacucaccccacgugguaaagacggcaacccagggggaggugaaugucacaggagccauuccucuuacuaccacaccaaccaaaagucauuucgcgaaccugaaggguacuaaaacaaggggcaaguuguguccgaccugcuuaaauuguacggaucuggacguggcucuagggcggcccaugugcguuggaaucacuccuagcgccaaggcauccauucuccacgaagugaaaccagucaccucuggcuguuuucccaucaugcaugaucgcacaaagauacgacaacugccuaaccuucugcgugguuacgagaaaaucagauugucgacucagaaugugauuaacgccgaaaaggcuccagggggacccuauaggcucggcaccucaggcagcugcccuaaugcaacaaguaaauccggguucuuugccaccauggcuugggccguaccacgggacaacaauaagacggcgacuaacccgcugacaguugaggugccccacaucuguaccaaggaagaggaucagauuacugucuggggauuccauucugacaauaaaccucagaugaagaaccuguacggugauagcaauccacaaaaauuuacauccucagcaaacggcaucaccacgcacuaugugagucagauagggggauuccccgagcagaccgaagacggcggucucccucagagcgggcgcauuguggucgauuacaugguucaaaagccaggaaaaacaggcacuaucguguaucagagaggcauuuuacugccccagaagguauggugcgccucugggagguccaaagugaucaagggaucacuuccguugaucggugaggcugacugucugcacgaaaaguacggcgggcuaaauaaaagcaagccuuauuacaccggagagcaugccaaagcaauuggcaacugccccauaugggucaagacaccacucaaacuggcuaacgguacuaaguaccggccucccgccaagcugcugaaagagcgcggguuuuucggcgcgaucgccggauuuuuggaaggcgggugggagggaaugauugcagguuggcacggcuauaccagucauggggcucacggaguggccguugcugccgaucucaagucuacacaggaagcaaucaauaaaauaaccaagaaccuuaauuccuuaagcgagcuggaagugaaaaaccuccaacgacuuucgggcgccauggacgagcugcacaaugagauuuuggaacuagaugagaaggucgacgaccugagagcugauacuaucucuucccagaucgaacucgcggugcugcuuucaaacgaggguauuaucaauagugaagacgagcaucuguuggcacucgagaggaagcugaaaaagauguuagggccaagcgccguagauauuggcaacggauguuucgaaacgaaacacaagugcaaucagacaugccuggaccggauagcugccggcaccuuuaacgcaggggaguucucccuacccacuuuugauucucucaauaucaccgccgcuagccugaacgacgauggacuugacaaucauacaauuuugcuguacuauucaaccgccgcaaguucccucgcgguuacucugaugaucgcuaucuucauuguguacaugauaagccgugauaacgucucuuguucaaucugccuuuga

SEQ ID NO: 148470 - RNA, 1758 nt, Artificial Sequence
  derived and/or modified sequence opt3 from hemagglutinin__InfluenzaB__ABL77068
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauaacgaaaaucagauggcuaagcuguauggggacucuaaaccccagaaguuuaccagcuccgccaacggagugacuacacacuacgucucacaaauuggcgguuucccuaaucagaccgaggaugggggacugccacagaguggccgcaucguuguggacuauaugguacagaaaagcggcaagacggggaccauuacauaccaaagaggaauccucuuaccccagaaaguguggugcgcgucugguagguccaaggucaucaaaggcucacugccucuuauuggggaagcagauuguuugcacgagaaguauggaggccugaacaagagcaaaccauacuacacuggugagcaugccaaggcuauagggaauugccccaucugggugaaaaccccgcuaaagcucgccaacggcacaaaauaucggccucccgcaaagcugcuuaaggaacgcggauuuuucggcgcuauugccggguuucuggagggagguugggaaggcaugaucgcgggguggcacggauacacaagucauggcgcccacgguguugcaguggcugccgacuugaaaucuacccaggaggcuauaaauaagauuacuaaaaaccucaauucccugagcgaauuagaggucaagaaccugcagcgacucucgggggccauggaugagcuucacaaugaaauccuggaguuggacgaaaaaguggaugaccuaagagcagacaccaucucuucccaaauugagcuggccguacuccugucaaacgaaggcaucauuaauagugaggaugagcaucuucuggcuuuggaaaggaagcucaagaaaaugcugggaccaagcgcgguugagauaggcaacggguguuucgaaacuaagcacaaaugcaaucagacgugcuuagaccggaucgcagccggaacauuuaacgcuggugaguucucccugccuaccuuugauucucuaaacauuacugccgcaagccucaaugacgauggccuggacaaccauaccauccuuuuguauuacucaacagccgcuaguucccuggccgugacccucaugaucgcaauuuucgucguguauauggucagccgugauaaugugucuuguucaauaugccuguga

SEQ ID NO: 148471 - RNA, 1758 nt, Artificial Sequence
  derived and/or modified sequence opt3 from hemagglutinin__InfluenzaB__ABL77090
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacacugaccaagagucauuucgccaauuugaaagguacuaagacaaggggcaaauuauguccaaagugccugaacuguaccgaucuagacguugcgcucgggcggccgaagugcacgggaaauauccccagcgcuaaaguguccauucugcacgaaguccgcccugugacuucuggcuguuuuccaaucaugcaugaucgaaccaagauacgucaacuucccaaccuguugagagguuacgagaggauccggcucucgaaucacaacguaauuaaugccgaaaaagcaccugggggaccauauaagaucggcacaucaggcagcugccccaacguuacuaaugggaacggauucuuugccaccauggcuugggcagugccuaaaaaugagaacaauaagacagccaccaacagucugacgauugaagucccauacaucuguacugagggugaggaccagauaacaguguggggcuuccauuccgauaacgaaauucagauggugaagcuguauggggacucuaaaccgcagaaguuuaccagcuccgcuaauggagucacuacacacuacguuucacaaaucggcgguuuccccaaccagauugaggaugggggacucccucagaguggccgcaucgugguagacuauauggugcagaaaagcggcaagaccgggacgaucaccuaccaaagaggaauuuuacugccacagaaagucuggugcgccucugguagguccaagauaaucaaaggcucacuucccuugauuggggaagcggauugucugcacgagaaguauggaggccuaaauaagagcaaaccuuacuacacaggugagcaugcaaaggccaucgggaacugcccaauaugggugaaaacuccccucaagcuggcuaauggcaccaaauaucggccgccugccaaacuucugaaggaacgcggauuuuucggcgcaauugcuggguuuuuggagggagguugggaaggcaugaucgccggguggcacggauacacaagucauggcgcgcacgguguugccguggcagcugaccucaagucuacucaggaggccaucaacaagauuaccaaaaaucugaacuccuuaagcgaacuggaggucaagaaucuccagcgacuuucgggggcuauggaugagcugcacaacgaaaucuuggagcuagacgaaaaaguggaugaccugagagccgacacaauuucuucccaaauagagcucgcaguacugcuuucaaaugaaggcaucauuaacagugaggaugagcaucuguuggcccucgaaaggaagcugaagaaaauguuaggacccagcgcuguugagaucggcaauggguguuucgaaaccaagcacaaaugcaaccagacuugccuggaccggaucgcggcaggaacguuuaaugccggugaguucucccuaccaacauuugauucucucaacauuaccgcugccagccugaacgacgauggccuugacaaucauacuauauugcuguauuacucaaccgcagccaguucccucgcugugacacugaugaucgccauuuucgucguguauauggucagccgugauaacgugucuuguucaaucugccuuuga

SEQ ID NO: 148472 - RNA, 1755 nt, Artificial Sequence
  derived and/or modified sequence opt3 from hemagglutinin__InfluenzaB__ABL77101
augaaggccaucauugugcugcucauggucguuaccagcaaagcugacagaauaugcacaggcaucacuuccucuaacucaccccacgugguaaagacggcaacccagggggaggugaaugucacaggagccauuccucuuacuaccacaccaaccaaaagucauuucgcgaaccugaaggguacuaaaacaaggggcaaguuguguccgaccugcuuaaauuguacggaucuggacguggcucuagggcggcccaugugcguuggaaucacuccuagcgccaaggcauccauucuccacgaagugaaaccagucaccucuggcuguuuucccaucaugcaugaucgcacaaagauacgacaacugccuaaccuucugcgugguuacgagaaaaucagauugucgacucagaaugugauuaacgccgaaaaggcuccagggggacccuauaggcucggcaccucaggcagcugcccuaaugcaacaaguaaauccggguucuuugccaccauggcuugggccguaccacgggacaacaauaagacggcgacuaacccgcugacaguugaggugccccacaucuguaccaaggaagaggaucagauuacugucuggggauuccauucugacgauaaaacacagaugaagaaucuguacggugacagcaacccucaaaaauuuaccuccucagcaaauggcaucacgacccacuaugugagucagauagggggauucccagagcagacagaagauggcggucucccccagagcgggcgcauuguggucgacuacaugguucaaaagccuggaaaaacuggcaccaucguguaucagagaggcauuuuacugccacagaagguauggugcgccucugggagguccaaagugaucaagggaucacuucccuugaucggugaggcugauugucugcacgaaaaguacggcgggcuaaacaaaagcaagccguauuacacaggagagcaugccaaagcaauuggcaauugcccuauaugggucaagacuccccucaaacuggcuaacgguaccaaguaccggccuccagccaaacuucugaaggagcgcggguuuuucggcgcgaucgccggauuuuuggaaggcgggugggagggaaugauugcagguuggcacggcuauacaagucauggggcucacggaguggccguugcugccgaccucaagucuacccaggaagcaaucaacaaaauaacuaagaaucugaacuccuuaagcgagcuggaagugaaaaaucuccaacgacuuucgggcgccauggaugagcugcacaacgagauuuuggaacuagacgagaaggucgacgaucugagagcugacacgaucucuucccagaucgaacucgcggugcugcuuucaaaugaggguauuaucaacagugaagaugagcaucuguuggcacucgagaggaagcugaaaaagauguuagggcccagcgccguagacauuggcaauggauguuucgaaacaaaacacaagugcaaccagaccugccuggaucggauagcugccggcacuuuuaaugcaggggaguucucccuaccaaccuuugacucucucaacaucacagccgcuagccugaaugaugacggacuugauaaccauaccauuuugcuguacuauucaacugccgcaaguucccucgcgguuacacugaugaucgcuaucuucauuguguacaugauaagccgugacaaugucucuuguucaaucugccuuuga

SEQ ID NO: 148473 - RNA, 1758 nt, Artificial Sequence
  derived and/or modified sequence opt3 from hemagglutinin__InfluenzaB__ABL77134
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauaacgaagcucagauggccaagcuguauggggacucuaaaccccagaaguuuaccagcuccgcgaauggagugacuacacacuacgucucacaaauuggcgguuucccuaaccagaccgaggaugggggacugccacagaguggccgcaucguuguggacuauaugguacagaaaagcggcaagacggggaccauuacauaccaaagaggaauccucuuaccccagaaaguguggugcgcaucugguagguccaaggucaucaaaggcucacugccucuuauuggggaagccgauuguuugcacgagaaguauggaggccugaauaagagcaaaccauacuacacuggugagcaugcuaaggccauagggaacugccccaucugggugaaaaccccgcuaaagcucgcaaauggcacaaaauaucggccucccgcuaagcugcuuaaggaacgcggauuuuucggcgccauugcgggguuucuggagggagguugggaaggcaugaucgccggguggcacggauacacaagucauggcgcacacgguguugcuguggccgcugacuugaaaucuacccaggaggccauaaacaagauuacuaaaaaucucaacucccugagcgaauuagaggucaagaaucugcagcgacucucgggggcaauggaugagcuucacaacgaaauccuggaguuggacgaaaaaguggaugaccuaagagccgacaccaucucuucccaaauugagcuggcuguacuccugucaaaugaaggcaucauuaacagugaggaugagcaucuucuggcguuggaaaggaagcucaagaaaaugcugggaccaagcgcaguugagauaggcaauggguguuucgaaacuaagcacaaaugcaaccagacgugcuuagaccggaucgccgcuggaacauuuaaugccggugaguucucccugccuaccuuugauucucuaaacauuacugcagccagccucaacgacgauggccuggacaaucauaccauccuuuuguauuacgcuacagccgcaucaagucuggcggugacccucaugaucgcuauuuucgucguguauauggucucccgugauaacgugagcuguucuauaugccuguga

SEQ ID NO: 148474 - RNA, 1758 nt, Artificial Sequence
  derived and/or modified sequence opt3 from hemagglutinin__InfluenzaB__ABL77145
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaagaggcaccagggggacccuauaaaaucggcacaucaggcagcugcccuaacguuacuaaugggaacggauucuuugccaccauggcuugggcagugccaaagaaugaaaacaauaaaacagccaccaacagucucacgauugaggucccguacaucuguacugagggugaagaccagauaacaguguggggcuuccauuccgauucugagacccagauggcuaagcuguauggggacagcaagccccagaaauuuacuuccucagccaacggagugacaacccacuacgucagucaaauuggcgguuucccuaaucagacggaagaugggggacugccacagagcggccgcaucguuguggacuauaugguacagaagucuggcaaaaccgggacaauuacuuaccaaagaggaauccucuuaccccagaagguguggugcgcguccgguaggucaaaagucaucaagggcagccugccucuuauuggggaggcagauuguuugcacgagaaauauggaggccugaacaagaguaagccauacuacaccggugaacaugccaaagcuauagggaauugccccaucugggugaagacaccgcuaaaacucgccaacggcacuaaguaucggccucccgcaaaacugcuuaaggagcgcggauuuuucggcgcuauugccggguuucuggaaggagguugggagggcaugaucgcgggguggcacggauacaccucucauggcgcccacgguguugcaguggcugccgacuugaaguccacacaggaagcuauaaauaaaauuaccaagaaccucaauagccugucggaguuagaggucaaaaaccugcagcgacucucuggggccauggaugaacuucacaaugagauccuggaauuggacgagaagguggaugaccuaagagcagacacuaucuccucacaaauugaacuggccguacuccugaguaacgagggcaucauuaauagcgaggaugaacaucuucuggcuuuggagaggaaacucaagaagaugcugggaccauccgcgguugaaauaggcaacggguguuucgagacgaaacacaagugcaaucagacaugcuuagaccggaucgcagccggaaccuuuaacgcuggugaguucucucugccuacuuuugauagccuaaauauuaccgccgcaucacucaacgacgauggccuggacaaccauacaauccuuuuguauuacaguaccgccgcuuccagccuggccgugacucucaugaucgcaauuuucgucguguauauggucucucgugauaaugugucauguaguauaugccuguga

SEQ ID NO: 148475 - RNA, 1755 nt, Artificial Sequence
  derived and/or modified sequence opt3 from hemagglutinin__InfluenzaB__ABL77156
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauguguguacagaaggagaggaucagauuaccgugugggguuuccauucugacgauaagacucagaugaaaaaucuguacggcgacagcaacccucaaaaguuuacauccucagcgaauggggucaccacgcacuauguuagucagaucggaggcuucccagaucagaccgaggacggugggcucccccagagcggaagaauugugguagauuacauggugcaaaagccuggcaaaacaggcacuaucgucuaucagaggggaguguuacugccacagaagguuuggugcgcaucugggcgguccaaagugauaaaggguucacuucccuugauuggcgaagccgacugucugcaugagaaauacgggggacuaaacaagagcaaaccguacuauaccggcgaacacgcuaaggccaucgguaacugcccuauuugggucaagacaccccucaaacuggcaaaugggacuaaguaccgcccuccagcuaaacuucugaaggagcgaggcuuuuucggagccaucgcgggcuuuuuggaagggggaugggaagguaugaucgccggcuggcacggguauaccagucauggagcacacggcguggcuguagccgcugaccucaaaucuacacaggaggccauuaacaagauaaccaagaaucugaacuccuuaagcgaacuggagguuaaaaaucuccaaagacuuucgggugcaauggaugaacugcauaacgagaucuuggagcuagacgaaaagguggaugaccugagggccgauacuauuucuucccagaucgagcucgcuguccugcuuucaaaugaagggauaauuaacagugaggacgaacaccuguuggcgcucgagcggaaacugaagaaaauguuaggccccagcgcaguggauaucggaaauggcuguuucgagacgaagcacaagugcaaccagacaugccuggaccguaucgccgcugggaccuuuaaugccggagaguucucccuaccaacuuuugauucucucaacauuaccgcagccagccugaaugacgauggucuugacaaccauacaaucuugcuguacuauucaaccgcugccaguucccucgcagucacucugaugcuugcgauuuucauaguguacaugguuagccgcgacaaugugucuuguucaaucugccuguga

SEQ ID NO: 148476 - RNA, 1758 nt, Artificial Sequence
  derived and/or modified sequence opt3 from hemagglutinin__InfluenzaB__ABL77178
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauucugaaacccagauggcuaagcuguauggggacagcaaaccccagaaguuuacuuccucagccaacggagugacaacccacuacgucagucaaauuggcgguuucccuaaucagacggaggaugggggacugccacagagcggccgcaucguuguggacuauaugguacagaaaucuggcaagaccgggacaauuacuuaccaaagaggaauccucuuaccccagaaaguguggugcgcguccgguaggucaaaggucaucaaaggcagccugccucuuauuggggaagcagauuguuugcacgagaaguauggaggccugaacaagaguaaaccauacuacaccggugagcaugccaaggcuauagggaauugccccaucugggugaaaacaccgcuaaagcucgccaacggcacuaaauaucggccucccgcaaagcugcuuaaggaacgcggauuuuucggcgcuauugccggguuucuggagggagguugggaaggcaugaucgcgggguggcacggauacaccucucauggcgcccacgguguugcaguggcugccgacuugaaauccacacaggaggcuauaaauaagauuaccaaaaaccucaauagccugucggaauuagaggucaagaaccugcagcgacucucuggggccauggaugagcuucacaaugaaauccuggaguuggacgaaaaaguggaugaccuaagagcagacacuaucuccucacaaauugagcuggccguacuccugaguaacgaaggcaucauuaauagcgaggaugagcaucuucuggcuuuggaaaggaagcucaagaaaaugcugggaccauccgcgguugagauaggcaacggguguuucgaaacgaagcacaaaugcaaucagacaugcuuagaccggaucgcagccggaaccuuuaacgcuggugaguucucucugccuacuuuugauagccuaaauauuaccgccgcaucacucaacgacgauggccuggacaaccauacaauccuuuuguauuacaguaccgccgcuuccagccuggccgugacucucaugaucgcaauuuucgucguguauauggucucucgugauaaugugucauguaguauaugccuguga

SEQ ID NO: 148477 - RNA, 1755 nt, Artificial Sequence
  derived and/or modified sequence opt3 from hemagglutinin__InfluenzaB__ABL77189
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggauccccaugugcgugggaacgacuccuagcgcuaaagccuccauucuccaugaaguccgcccagugaccucuggcuguuuucccaucaugcacgaccgaacaaagauacgucaacugccuaaucuucugagagguuaugagaacaucagguugucgacucagaauguaauugaugcagaaaaggccccagggggacccuaccggcucggcaccucaggcagcugcccuaacgcuacaaguaaauccggguucuuugcaaccauggccugggcuguuccaaaggacaauaacaaaaaugccacgaacccgcugacuguggagguccccuauguguguacagaaggagaggaucagaucaccgugugggguuuccauucugacaauaagauucagaugaaaaaccuguacggcgauagcaauccucaaaaguuuacuuccucagcgaacggggucacaacccacuauguuagucagaucggaggcuucccagaccagacggaggauggugggcucccccagagcggacgcauagugguagacuacauggugcaaaagccuggcaaaaccggcacaauugucuaucagagagggguguuacugccacagaagguuuggugcgcaucuggaagguccaaagugaucaaggguucacuucccuugauuggcgaagccgauugucugcaugagaaauacgggggacuaaacaagagcaaaccguacuauacuggcgaacacgcuaaggccaucgguaauugcccuaucugggucaagaccccacucaaacuggcaaacgggacaaaguaccggcccccugcuaaacuucugaaggagcgcggcuuuuucggagccauugcgggcuuuuuggaagggggaugggaagguaugauagccggcuggcacggguauacuucccauggagcacacggcguggcuguagccgcugaccucaaaucuacccaggaggccaucaauaagauuacaaagaaccugaauaguuuaagcgaacuggagguuaaaaaccuccaacgacuuucgggugcaauggacgaacugcauaaugagaucuuggagcuagaugaaaagguggacgaucugagagccgacaccauaucuucccagauugagcucgcuguccugcuuucaaacgaagggaucaucaauagugaggaugaacaccuguuggcgcucgagaggaaacugaagaaaauguuaggccccagcgcaguggacauuggaaacggcuguuucgagacuaagcacaagugcaaucagacgugccuggaucggaucgccgcugggacauuuaacgccggagaguucucccuaccaaccuuugacucucucaauauuacugcagccagccugaacgaugacggucuugauaaucauaccauauugcuguacuauucaacagcugccaguucccucgcagucacccugaugcuugcgaucuucauuguguacaugguuagccgugacaacgugucuuguucaaucugccuguga

SEQ ID NO: 148478 - RNA, 1758 nt, Artificial Sequence
  derived and/or modified sequence opt3 from hemagglutinin__InfluenzaB__ABL77200
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcaugggaaauaucccuagcgcuaaaguguccauucuccacgaaguccgcccagugacgucuggcuguuuucccaucaugcaugaucgaacuaagauacgucaacugccuaaccuucugagagguuacgagcacaucagguugucgacccauaauguaauuaacgccgaaaaagcaccagggggacccuauaagaucggcacaucaggcagcugcccuaauguuacuaacgggaauggauucuuugccaccauggcuugggcagugccgaaaaacgacaauaacaagacagccaccaauagucucacgauugaggucccauacaucuguacugaaggugaggaucagauaacaguguggggcuuccacuccgacaacgagacccagauggcuaagcuguauggggauucuaaaccccagaaguuuacuagcuccgccaacggagugacaacccacuacgucucacaaauuggcgguuucccuaaucagacggaagacgggggacugccacagaguggccggaucguuguggauuauaugguacagaaaagcggcaaggcggggaccauuacauaccaacgcggaauccucuuaccccagaaaguguggugcgcaucugguagauccaaggucaucaaaggcucacugccucuuauuggggaggccgacuguuugcaugaaaaguauggaggccugaacaagagcaaaccauacuacacuggugagcacgcuaaggccauagggaauugccccaucugggugaaaaccccgcuaaagcucgcaaacggcacaaaauauaggccucccgcuaagcugcuuaaggagcggggauuuuucggcgccauugcgggguuucuggaaggagguugggagggcaugaucgccggguggcauggauacacaagucacggcgcacacgguguugcuguggccgcugauuugaaaucuacccaggaagccauaaauaagauuacuaaaaaccucaauucccugagcgaguuagaagucaagaaccugcagcgccucucgggggcaauggacgagcuucauaaugagauccuggaauuggauggcaaaguggacgaccuacgagccgauaccaucucuucccaaauugagcuggcuguacuccugucaaacgaaggaaucauuaauagugaggacgaacaccuucuggcguuggagagaaagcucaagaaaaugcugggcccaagcgcaguugagauagggaacggauguuucgaaacuaagcauaaaugcaaucagacgugcuuagauaggaucgccgcugguacauuugacgccggcgaguucucccugccuaccuuugauucucuaaacauuacugcagccagccucaaugacgaugggcuggacaaccacaccauccuuuuguauuacucaacagcugccaguucccuggcagugacccucaugaucgcgauuuucgucguguauauggucagccgggauaacgugucuuguucaauaugccuguga

SEQ ID NO: 148479 - RNA, 1755 nt, Artificial Sequence
  derived and/or modified sequence opt3 from hemagglutinin__InfluenzaB__ABL77222
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacagcaagacucagaugaaaaaucuguacggcgauuccaacccccaaaaguuuacaucaagugcaaauggggugaccacgcacuaugucagccagauuggaggcuucccugaccagaccgaggauggugggcucccacagucuggaagaaucguuguggacuacaugaugcaaaagcccggcaaaacaggcacuauaguauaucagcgcgggguguuacugccucagaaggucuggugcgccuccggacggucaaaagugauuaaggguagccuuccauugaucggcgaagcugauugucugcaugagaaauacgggggacuaaacaagaguaaacccuacuauaccggcgaacacgccaaggcaauugguaacugcccgaucuggguuaagacaccucucaaacuggcuaaugggacuaaguacaggcccccagccaaacuucugaaggagcgaggcuuuuucggagcgaucgccggcuuuuuggaagggggaugggaagguaugauugcaggcuggcacggguauaccucucauggagcucacggcguggccgucgcugccgaccucaaauccacacaggaggcaauaaacaagaucaccaagaaucugaacagcuuaucggaacuggaggugaaaaaucuccaaagacuuucuggugccauggacgaacugcauaacgagauuuuggagcuagaugaaaagguagacgaucugagggcugacacuaucuccucacagauagagcucgcgguucugcuuaguaaugaagggauuaucaacagcgaggaugaacaccuguuggcacucgagcggaaacugaagaaaauguuaggcccuuccgccguggacaucggaaauggcuguuucgagacgaagcacaagugcaaccagacaugccuggaucguauugcugccgggaccuuuaaugcaggagaguucucucuacccacuuuugacagccucaacaucaccgccgcuucacugaaugaugacggucuugauaaccauacaauuuugcuguacuauaguaccgccgcauccagccucgcggucacucugaugcuugcuauauucaucguguacauggucucucgcgacaaugugucauguaguauuugccuguga

SEQ ID NO: 148480 - RNA, 1758 nt, Artificial Sequence
  derived and/or modified sequence opt3 from hemagglutinin__InfluenzaB__ABL77233
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaagcucagauggccaagcuguauggggauucuaagccccagaaauuuacuagcuccgcgaacggagugacaacccacuacgugucacaaaucggcgguuucccuaaucagacggaggacgggggacugccacagaguggccggauugucguugauuauauggugcaaaagagccgcaaaaccggcacaaucacuuaccagagagggauccucuuaccccagaagguauggugcgcaucuggaagguccaaagugauuaaggguucacugccucuuauaggcgaagccgacuguuugcaugagaaauaugggggacugaacaagagcaagccauacuacaccggcgagcacgcuaaagccaucgguaauugccccauuugggucaagacaccgcuaaaacucgcaaacgggacuaaguaucggccucccgcuaaacugcuuaaggaacgcggcuuuuucggagccaucgcgggcuuucuggaagggggaugggaggguaugauagccggcuggcauggguacaccagucacggagcacacggcguggcuguugccgcugauuugaagucuacacaggaggccauuaauaaaaucaccaagaaccucaauucccugagcgaauuagaggugaaaaaccugcagcgacucucgggugcaauggacgagcuucauaaugaaauccuggaguuggaugaaaaggucgacgaccuaagagccgauacuauuucuucccaaaucgagcuggcugugcuccugucaaacgaagggauuauaaauagugaggacgagcaccuucuggcguuggaaaggaaacucaagaagaugcugggcccaagcgcaguagagaucggaaacggcuguuucgaaacgaaacauaagugcaaucagacaugcuuagaucggauugccgcugggaccuuugacgccggagaguucucccugccuacuuuugauucucuaaacaucaccgcagccagccucaaugacgauggucuggacaaccacacaauccuuuuguauuacucaaccgcugccaguucccuggcaguuacucucaugauugcgauauucguggucuauauggugagccgugauaacgucucuuguucaaucugccuguga

SEQ ID NO: 148481 - RNA, 1758 nt, Artificial Sequence
  derived and/or modified sequence opt3 from hemagglutinin__InfluenzaB__ABL77244
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaacuaucccuagcgcuaaagccuccauucuccacgaagugaagccagucaccucuggcuguuuucccaucaugcaugaucgcacaaaaauacgacaacugccuaaucuucugcgugguuacgagcacaucagauugucgacucauaacgugauuaaugcagaaaccgccccagggggacccuauaagguaggcacaucaggcagcugcccuaacguuaccaaugggaacggauucuuugcuacgauggcaugggccgugccgaaaaaugacaacaauaagacugcuacaaacccacucaccgucgaggugcccuacaucuguacugaaggugaggaucagauuacaguguggggcuuccacagugacaaugaggcccagauggucaagcuguauggggauuccaaaccucagaaguuuaccucuagcgcgaacggaguuacgacccacuacgugucccaaaucggcgguuucccaaaccaggcagaagacgggggacugccccagucaggcaggauaguaguggauuauaugguccagaaaaguggcaagacagggacuauuaccuaccaacggggaauccucuuaccucagaaaguguggugcgccagcggucgcucuaagguuauuaaaggcucccugccacuuaucggggaggcugacuguuugcaugaaaaguauggaggccugaauaagucaaaacccuacuacacaggugagcacgccaaggcaaucgggaacugcccgauuugggugaaaacuccucuaaagcucgcuaauggcaccaaauauagacccccagccaagcugcuuaaggagaaaggauuuuucggcgcgauagccggguuucuggaaggagguugggagggcaugaucgcaggguggcauggauacacaagccacggcgcucacggugucgccguggcugccgauuugaagaguacccaggaagcaauuaacaaaaucacuaagaaucucaacucucuguccgaguuagaaguuaaaaaucugcagaggcucagcggggccauggacgagcuucauaacaagauacuggaguuggaugaaaagguagacgaccuacgggcugauacgauuucgucucaaaucgagcuggcggugcuccuguccaaugaaggcaucauuaacucagaggacgaacaccuucuggcauuggagcgcaaacucaagaaaaugcugggaccuagugccgucgagaucggcaauggguguuucgaaacaaagcauaaaugcaaccagaccugcuuagaucgaauugcugccggaacuuuuaaugccggugaguucagccugcccaccuuugacucccuaaacauaacagcagcuucucucaaugaugacggccuggauaaccacaccauccuuuuguauuacagcacugccgcaucaagucuggcggugacacucaugauugcuaucuucaucgucuauaugguguccagagacaacguuagcuguucuauuugccuguga

SEQ ID NO: 148482 - RNA, 1752 nt, Artificial Sequence
  derived and/or modified sequence opt3 from hemagglutinin__InfluenzaB__ABL77255
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaugggaacgaucccuagcgcuaaggccuccauucuccacgaagugcgcccagucacuucuggcuguuuucccaucaugcaugaucgaaccaagauacgucaacugccuaaccuucugagagguuacgagaauaucagguugucgacacacaacgugauuaaugcagaacgggccccagggggacccuaucgccucggcacuucaggcagcugcccuaacguaaccaguagaaauggguucuuugcuacaauggcaugggccguuccaagggacaacaaaaccgcuacgaauccgcugacuguggagguccccuacaucuguacaaagggagaagaucagauuaccgugugggguuuccauuccgacgauaaaacucagaugaagaaccuguauggcgacucuaauccucagaaauuuacaagcuccgccaacggggugaccacgcacuacgucucacaaaucggagauuucccaaaccagaccgaggacggcggucucccccagagugggcggauaguuguggauuauaugguacagaagccuggaaagacaggcacuauuguguaccaacgcggcgucuuacugccacagaaaguguggugcgcgagcgggcgaucuaagguuaucaaaggaucccuucccuugauuggugaggcagacugucugcacgaaaaguauggcgggcuaaauaaaucaaagccguacuacaccggagagcaugccaaagcuaucggcaacugcccuaucugggugaagacaccccucaagcuggccaaugguacuaaauauagaccuccagcaaaacuucugaaggaaaggggguuuuucggcgcuauugccggauuuuuggagggcgggugggagggaaugauagcggguuggcacggcuacaccagccauggggcccacggagucgcaguggcugccgaucucaagaguacacaggaagcuaucaacaaaauuaccaagaaucugaacucuuuauccgagcuggaaguaaagaaucuccagcggcuuagcggcgccauggacgagcugcacaacgaaaucuuggagcuagacgagaaaguugaugaccugcgugcagauacuauaucgucucaaauugaacucgccgugcugcuuuccaaugaggguaucaucaacucagaagacgagcaucuguuggcucucgaacgcaagcugaaaaagauguuagggcccagugcggucgauauuggcaauggauguuucgagacgaaacacaagugcaaccagacaugccuggacagaaucgcagccggcaccuuuaaugcuggggaguucagccuaccaacuuuugauucccucaacauuaccgccgcaucucugaaugacgauggacuugacaaccauacaauauugcuguauuacagcaccgccgcuucaagucucgccgugacucugaugaucgcaauuuucaucgucuauaugguguccagggauaacguuagcuguucuaucugccuuuga

SEQ ID NO: 148483 - RNA, 1752 nt, Artificial Sequence
  derived and/or modified sequence opt3 from hemagglutinin__InfluenzaB__ABL77266
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaacgggccccagggggacccuaucgccucggcaccucaggcagcugcccuaacguuacaaguagagacggguucuuugcuaccauggcaugggccgugccaagggauaauaaaacggcuacuaacccgcugacagucgaggugcccuacauuuguaccaagggagaagaccagaucacugugugggguuuccacuccgauucuaaaacacagaugaagaaucuguauggcgacagcaacccucaaaaauuuaccuccucagccaauggggucacgacccauuacguuagucagauuggaggcuucccaaaccagacagaggauggugggcucccccagagcggacggaucgugguagacuauauggugcaaaagccuggcaagacuggcaccauagucuaccagcgcgggguguuacugccacagaaaguuuggugcgcgucuggacgauccaaggugauuaaagguucacuucccuugaucggcgaggcagauugucugcacgaaaaguaugggggacuaaacaaaagcaagccguacuacacaggcgagcacgccaaagcuauugguaauugcccuaucugggucaagacuccccucaagcuggccaacgggaccaaauauagaccuccagcaaagcugcugaaagaaaggggcuuuuucggagcuaucgccggcuuuuuggaagggggaugggaggguaugauugcgggcuggcauggguacacaagucacggagcccauggcguggcaguagcugccgaccucaagucuacccaggaggcuauaaauaaaaucacuaagaaccuuaauuccuuaagcgagcuggaaguuaagaaccuccaacggcuuucgggugccauggaugagcugcacaaugaaauuuuggagcuagacgagaaaguggacgaucugcgugcagacacgaucucuucccagauagaacucgccguccugcuuucaaacgaggggauuaucaauagugaagaugagcaccuguuggcucucgaacgcaagcugaaaaagauguuaggccccagcgcgguggacaucggaaacggcuguuucgagacaaaacauaagugcaaucagaccugccuggauagaauugcagccgggacuuuuaacgcuggagaguucucccuaccaaccuuugacucucucaauaucacagccgcaagccugaacgaugacggucuugauaaucacaccauuuugcuguauuacucaacugccgcuaguucccucgccgucacacugaugauagcaaucuucauuguguauaugguuagcagggacaacgugucuuguucaaucugccuuuga

SEQ ID NO: 148484 - RNA, 1752 nt, Artificial Sequence
  derived and/or modified sequence opt3 from hemagglutinin__InfluenzaB__ABL77277
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaaacacgccuagcgcuaaggccuccauccuccacgaaguccgcccagugacuucuggcuguuuucccauuaugcaugaucgaaccaagauccgucaacugccuaaucuucugagagguuacgagaacauaagguugucgacacagaauguaaucaacgcagaacgggccccagggggacccuaucgccucggcacuucaggcagcugcccuaauguuaccaacagagacggguucuuugcuacaauggcaugggccgugccaagggauaauaaaaccgcuacgaacccgcugacugucgaggugcccuacauuuguacaaagggagaagaccagaucaccgugugggguuuccacagugauaauaaaauucagaugaagaaccuguauggcgacuccaacccucaaaaauuuacuucuagcgccaauggggucacaacccauuacguuucccagaucggaggcuucccaaaccagacggaggauggugggcucccccagucaggacggauagugguagacuauauggugcaaaagccuggcaagaccggcacaauugucuaccagcgcgggguguuacugccacagaaaguuuggugcgcgaguggacgaagcaaggugaucaaagguucucuucccuugauuggcgaggcagauugucugcacgaaaaguaugggggacuaaauaaauccaagccguacuacacuggcgagcacgccaaagcuaucgguaacugcccuaucugggucaagaccccacucaagcuggccaaugggacaaaauauagacccccugcaaaacuucugaaggaaaggggcuuuuucggagcuauugccggcuuuuuggaagggggaugggaggguaugauagcgggcuggcauggguacacuucacacggagcccauggcguggcaguagcugccgaccucaagagcacccaggaggcuaucaacaaaauuacaaagaaucugaacaguuuaucugagcuggaaguuaagaaucuccaacggcuuuccggugccauggaugagcugcacaacgaaaucuuggagcuagacgagaaaguggacgaucugcgugcagacaccauaagcucgcagauugaacucgccguccugcuuucuaaugaggggaucaucaacuccgaagaugagcaccuguuggcucucgaacgcaagcugaaaaagauguuaggccccucagcgguggacauuggaaauggcuguuucgagacuaaacauaagugcaaccagacgugccuggauagaaucgcagccgggacauuuaaugcuggagaguucagucuaccaaccuuugacagccucaacauuacugccgcaucccugaacgaugacggucuugauaaucacaccauauugcuguauuacucuacagccgcuagcucacucgccgucacccugaugaucgcaauuuucaucguguauaugguuaguagggacaacguguccuguagcaucugccuuuga

SEQ ID NO: 148485 - RNA, 1752 nt, Artificial Sequence
  derived and/or modified sequence opt3 from hemagglutinin__InfluenzaB__ABL77288
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagcacauaagguugucgacucagaauguaaucaacgcagaaaaagccccagggggacccuauaagcucggcaccucaggcagcugcccuaaugcuacaagucgguccggguucuuugcaaccauggccugggcuguuccacgcgacaacaaaacggccacuaauccgcugacaguggagguccccuacauuuguaccaagggagaagaucagaucacugugugggguuuccauucugacacaaaaacccagaugaagaaccuguauggcgauagcaauccucaaaaguuuacguccucagcgaacggggugaccacacacuacgucagucagauuggaggcuucccagaccagacugaggauggugggcucccccagagcggaagaaucguuguggacuauaugguacaaaaaccuggcaagaccggcacaauaguguaccagaggggagucuuacugccacagaaaguguggugcgcaucugggcgguccaagguuauuaaagguucacuucccuugaucggcgaggccgauugucugcacgaaaaguaugggggacuaaauaaaagcaagccguacuacacuggcgagcaugcuaaggccauugguaacugcccuaucugggugaaaaccccucucaagcuggcaaacgggacaaaauaucgcccacccgcuaagcugcugaaagaacgaggcuuuuucggagccaucgcgggcuuuuuggaagggggaugggaggguaugauugccggcuggcacggguacaccagucauggagcacacggcgucgcuguggccgcugaccucaagucuacucaggaggccauaaauaagaucacgaaaaaccuuaauuccuuaagcgagcuggaaguaaagaaccuccaaagacuuucgggugcaauggaugagcugcacaaugaaauuuuggagcuagacgagaaaguugacgaucugagggccgacacaaucucuucccagauagaacucgcugugcugcuuucaaacgaggggauuaucaauagugaagaugagcaucuguuggcgcucgaacggaagcugaaaaagauguuaggccccagcgcagucgacaucggaaacggcuguuucgagaccaagcacaaaugcaaucagacuugccuggaucguauugccgcugggaccuuuaacgccggagaguucucccuaccaacauuugacucucucaauaucaccgcagccagccugaacgaugacggucuugauaaucauacuauuuugcuguauuacucaacagcugccaguucccucgcagugacgcugaugauagcgaucuucauugucuauauggugagccgcgacaacguuucuuguucaaucugccuuuga

SEQ ID NO: 148486 - RNA, 1752 nt, Artificial Sequence
  derived and/or modified sequence opt3 from hemagglutinin__InfluenzaB__ABL77299
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaaacauuccuagcgcuaaggccuccauccuccacgaagugcgcccagucacgucuggcuguuuucccauaaugcaugaucgaacuaagauccgucaacugccuaaucuucugagagguuacgagcacauuagguugucgacccauaacgugaucaaugcagaacgggccccagggggacccuaucgccucggcacaucaggcagcugcccuaacguaacaaguagauccggguucuuugcuaccauggcaugggccguuccaagggacaauaaaacagcuaccaacccgcugacgguggagguccccuacauuuguacuaagggagaagaucagaucacagugugggguuuccacucugacaaugagacccagaugaaaaaccuguauggcgauagcaauccucagaaguuuacuuccucagccaacgggauaacaacccacuacgugagucaaauuggaggcuucccaaaccagacggaggacggugggcucccccagagcggacggaucgucguugauuauauggugcagaaaccuggcaagaccggcacaauuguauaccaacgcgggguguuacugccacagaaggucuggugcgcgucuggacgauccaaagugaucaaggguucacuucccuugaucggcgaagcagacugucugcaugagaaauaugggggacuaaauaagagcaaaccguacuacacuggcgaacacgccaaggcuauugguaacugcccuauauggguuaaaacuccccucaagcuggccaaugggacaaaguauagaccuccagcaaaacuucugaaggagaggggcuuuuucggagcuaucgccggcuuuuuggaagggggaugggaagguaugauugcgggcuggcauggguacaccagucacggagcccacggcguggcagucgcugccgaucucaaaucuacccaggaggcuaucaacaagauaacuaaaaaucugaacuccuuaagcgaacuggaggugaagaaucuccagcggcuuucgggugccauggacgaacugcauaacgagauuuuggagcuagaugaaaagguagacgaccugcgugcagauaccaucucuucccaaaucgagcucgccguucugcuuucaaaugaagggauuaucaacagugaggacgaacaccuguuggcucucgagcgcaaacugaagaaaauguuaggccccagcgcgguggauauuggaaauggcuguuucgagacuaagcauaaaugcaaccagacgugccuggacagaauagcagccgggacauuuaaugcuggagaguucucccuaccaaccuuugauucucucaacaucacugccgcaagccugaaugacgauggucuugacaaccacaccauuuugcuguauuacucaacagccgcuaguucccucgccgucacccugaugaucgcaaucuucauuguguauauggucagcagggauaacgugucuuguucaauaugccuuuga

SEQ ID NO: 148487 - RNA, 1752 nt, Artificial Sequence
  derived and/or modified sequence opt3 from hemagglutinin__InfluenzaB__ABL77310
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacaacaaaaaucagaugaagaaccuguauggcgauagcaauccucagaaauuuacuuccucagccaacggggugacaacccacuacgucagucaaauaggaggcuucccaaaccagacggaggacggugggcucccccagagcggacggauuguuguggauuauaugguacagaagccuggcaagaccggcacaaucguguaccaacgcggggucuuacugccacagaaaguguggugcguuucuggacgauccaaggugauuaaagguucacuucccuugaucggcgaggcggacugucugcaugaaaaguaugggggacuaaauaaaagcaagccguacuacacuggcgagcacgcaaaagccaucgguaacugcccuauuugggucaagacuccccucaagcuggcuaaugggacaaaauauagaccuccagccaaacuucugaaggaaaggggcuuuuucggagcaauagcuggcuuuuuggaagggggaugggaggguaugaucgccggcuggcauggguacaccagucacggagcgcacggcguggccguagcagcugaucucaagucuacccaggaggccauuaacaaaaucacaaagaaucugaacuccuuaagcgagcuggaaguuaagaaucuccagcggcuuucgggugcuauggacgagcugcauaacgaaauauuggagcuagaugagaaaguggacgaccugcgugccgauaccauuucuucccaaaucgaacucgcaguccugcuuucaaaugaggggaucauuaacagugaagacgagcaccuguuggcccucgaacgcaagcugaaaaagauguuaggccccagcgcuguggauaucggaaauggcuguuucgagacuaaacauaagugcaaccagacgugccuggacagaauugcggcagggacauuuaaugccggagaguucucccuaccaaccuuugauucucucaacauaacugcugccagccugaaugacgauggucuugacaaccacaccaucuugcuguauuacucaacagcagccaguucccucgcugucacccugaugauugccaucuucaucguguauaugguuagcagggauaacgugucuuguucaauuugccuuuga

SEQ ID NO: 148488 - RNA, 1758 nt, Artificial Sequence
  derived and/or modified sequence opt3 from hemagglutinin__InfluenzaB__ABL77321
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaacuaucccuagcgcuaaaguguccauucuccacgaagucaagccagugaccucuggcuguuuucccaucaugcaugaucgcacaaaaauacgacaacugccuaaucuucugcgugguuacgagcacaucagauugucgacucauaacguaauuaaugccgaaaaggcaccagggggacccuauaaaaucggcaccucaggcagcugcccuaacauuacaaaugggaacggauucuuugccaccauggcuugggcaguuccaaagaaugacaacaauaagacggccacuaacagucucacaguggaggucccguacaucuguaccgaaggugaggaucagauaacuguguggggcuuccacuccgacaaugagacacagauggcuaaacuguauggggauucuaagccccagaaauuuaccagcuccgccaacggagugacgacccacuacgucucacaaauuggcgguuucccuaaccaggcggaagacgggggacugccacagaguggcaggaucguuguggauuauaugguacaaaagagcggcaaaacagggacuauuaccuaccagcggggaauccucuuaccccagaagguguggugcgcaucuggucgcuccaaagucaucaagggcucacugccucuuauuggggaggccgacuguuugcaugaaaaguauggaggccugaauaaaagcaagccauacuacacaggugagcacgcuaaagccauagggaacugccccaucugggugaagacuccgcuaaaucucgcaaacggcaccaaauauagaccucccgcuaagcugcuuaaggagaggggauuuuucggcgccauugcgggguuucuggaaggagguugggagggcaugaucgccggguggcauggauacacaagucacggcgcacacgguguugcuguggccgcugauuugaaaucuacccaggaagccauaaauaagauuacuaaaaaccucaauucccugagcgaguuagaagucaagaaccugcagcggcucucgggggcaauggacgagcuucauaaugagauccuggaauuggaugagaaaguggacgaccuacgcgccgauacgaucucuucccaaauugaacuggcuguacuccugucaaacgagggcaucauuaauagugaagacgagcaccuucuggcguuggagcgaaagcucaagaaaaugcugggaccaagcgcaguugaaauaggcaacggguguuucgagacaaagcauaaaugcaaucagaccugcuuagauagaaucgccgcuggaacuuuuaacgccggugaguucucccugccuaccuuugacucucuaaauauuacagcagccagccucaacgaugacggccuggauaaccacaccauccuuuuguauuacucaacugcugccaguucccuggcagugacacucaugaucgcgauuuucauagucuauauggugagcagggacaaugucucuuguucaaucugccuguga

SEQ ID NO: 148489 - RNA, 1755 nt, Artificial Sequence
  derived and/or modified sequence opt3 from hemagglutinin__InfluenzaB__ABL77332
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuauaagcucggcaccucaggcagcugcccuaacgcuacaagucgguccggguucuuugcaaccauggccugggcuguuccacgcgacaauaacaaaacggccacuaauccgcugacaguggagguccccuacauuuguaccaagggagaagaucagaucacugugugggguuuccacucugacgauaaaacacagaugaagaaccuguauggcgacagcaauccucaaaaguuuaccuccucagcgaacggggugacgacccauuacgucagucagauuggaggcuucccagaucagacagaggacggugggcucccccagagcggaagaaucguuguggauuauaugguacaaaaaccuggcaagacuggcaccauaguguaccagaggggagucuuacugccacagaaaguguggugcgcaucugggcgguccaagguuauuaaagguucacuucccuugaucggcgaggccgacugucugcacgaaaaguaugggggacuaaacaaaagcaagccguacuacacaggcgagcacgcuaaggccauugguaauugcccuaucugggugaaaacuccccucaagcuggcaaacgggaccaaauaucgcccuccagcuaagcugcugaaagaacgaggcuuuuucggagccaucgcgggcuuuuuggaagggggaugggaggguaugauugccggcuggcauggguacacaagucacggagcacauggcgucgcuguggccgcugaucucaagucuacccaggaggccauaaauaagaucacuaaaaaccuuaauuccuuaagcgagcuggaaguaaagaaccuccaaagacuuucgggugcaauggacgagcugcacaaugaaauuuuggagcuagacgagaaaguugaugaccugagggccgauacgaucucuucccagauagaacucgcugugcugcuuucaaacgaggggauuaucaauagugaagacgagcaccuguuggcgcucgaacggaagcugaaaaagauguuaggccccagcgcagucgauaucggaaacggcuguuucgagacaaagcauaaaugcaaucagaccugccuggaccguauugccgcugggacuuuuaacgccggagaguucucccuaccaaccuuugauucucucaauaucacagcagccagccugaacgacgauggucuugacaaucacgcuauuuugcuguauuacucaaccgccgcaaguucccucgcggugacucugaugauagcuaucuucauugucuauauggugagccgcgauaacguuucuuguucaaucugccuuuga

SEQ ID NO: 148490 - RNA, 1755 nt, Artificial Sequence
  derived and/or modified sequence opt3 from hemagglutinin__InfluenzaB__ABL77343
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacaauaacaagacggccacuaauccgcugacaguggagguccccuacauuuguaccaaaggagaagaucagaucacugugugggguuuccacucugacaacaagauucagaugaaaaaucuguauggcgauagcaacccucaaaaguuuacauccucagcgaacggggugaccacgcauuacgucagucagaucggaggcuucccagaccagaccgaggauggugggcucccccagagcggaaggauaguuguggacuauaugguacaaaagccuggcaaaacaggcacuauuguguaccagcgcggggucuuacugccacagaagguguggugcgcaucuggacgguccaaaguugugaaggguucacuucccuugaucggcgaggccgauugucugcacgaaaaauaugggggacuaaauaagagcaaaccguacuacaccggcgagcacgcuaaggccauugguaacugcccuaucugggucaagacaccccucaaacuggcaaaugggacuaaguaucgaccuccagcuaaacuucugaaggaaagaggcuuuuucggagccaucgcgggcuuuuuggaagggggaugggaggguaugauugccggcuggcauggguacaccagucacggagcacauggcguggcuguagccgcugaccucaaaucuacacaggaggccauaaacaagaucaccaagaaucugaacuccuuaagcgagcuggaaguuaaaaaucuccaaaggcuuucgggugcaauggaugagcugcacaacgaaauuuuggagcuagacgagaagguggacgaucugcgggccgacacuaucucuucccagauagaacucgcuguccugcuuucaaaugaggggauuaucaacagugaagaugagcaccuguuggcgcucgaacguaaacugaagaaaauguuaggccccagcgcaguggacaucggaaauggcuguuucgagacgaagcauaagugcaaccagacaugccuggaucgcauugccgcugggaccuuuaaugccggagaguucucccuaccaacuuuugacucucucaacaucaccgcagccagccugaaugaugacggucuugauaaccacacaauuuugcuguauuacucaaccgcugccaguucccucgcagucacucugaugauagcgaucuucauuguguauaugguuagcagagacaacgugucuuguucaaucugccuuuga

SEQ ID NO: 148491 - RNA, 1755 nt, Artificial Sequence
  derived and/or modified sequence opt3 from hemagglutinin__InfluenzaB__ABL77365
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacaauaacaagacggccacuaauccgcugacaguggagguccccuacguguguaccgaaggagaggaucagauuacugugugggguuuccacucugacaacaaaacacagaugaagaaucuguauggcgauagcaacccucaaaaauuuaccuccucagcgaacggggucacgacccauuacguuagucagaucggaggcuucccagaccaggcagaggauggugggcucccccagagcggaaggauugugguagacuauauggugcaaaagccuggcaagacaggcacuaucgucuaccagcgcgggguguuacugccacagaaaguuuggugcgccucuggacgguccaaggugauaaaagguucacuucccuugauuggcgaagcugauugucugcacgagaaguaugggggacuaaauaaaagcaagccguacuacaccggcgaacacgccaaagcaaucgguaacugcccuauuugggucaagacaccccucaagcuggcuaaugggacuaaauaucgaccuccagccaaacuucugaaggagagaggcuuuuucggagcgaucgccggcuuuuuggaagggggaugggaagguaugaucgcaggcuggcauggguacaccagucacggagcucauggcguggccguagcugccgaccucaagucuacacaggaggcaauuaacaaaauaaccaagaaucugaacuccuuaagcgaacuggagguuaagaaucuccaaaggcuuucgggugccauggaugaacugcacaacgagaucuuggagcuagacgaaaaaguggacgaucugcgggcugacacuauuucuucccagaucgagcucgcgguccugcuuucaaaugaagggauaauuaacagugaggaugaacaccuguuggcacucgagcguaagcugaaaaagauguuaggccccagcgccguggacaucggaaauggcuguuucgagacgaaacauaagugcaaccagacaugccuggaucgcaucgcugccgggaccuuuaaugcaggagaguucucccuaccaacuuuugacucucucaacauuaccgccgcuagccugaaugaugacggucuugauaaccacacaaucuugcuguauuacucaaccgccgcaaguucccucgcggucacucugaugauugcuauauucaucguguauaugguuagcagagacaacgugucuuguucaauuugccuuuga

SEQ ID NO: 148492 - RNA, 1755 nt, Artificial Sequence
  derived and/or modified sequence opt3 from hemagglutinin__InfluenzaB__ABL84340
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacacaaccaguaaauccggguucuuugcuacgauggcaugggccguuccacgcgacaauaacaagacugcuacaaauccgcugaccguggaggucccccacaucuguacuaaagaagaggaucagauuacaguguggggauuccauucugacaacaagacccagaugaagaaucuguacggugauagcaacccucaaaaauuuacguccucagccaauggcgugaccacacacuaugucagucagaucgggggauucccagaccagacugaggauggcggucucccccagagcgggagaauaguuguggacuacaugguacaaaagccuggaaaaaccggcacaauuguguaucagaggggcaucuuacugccacagaaggucuggugcgcgucugggcgguccaaagugauuaagggaucacuucccuugaucggugaagcagauugucugcacgagaaauacggcgggcuaaacaagagcaagccguauuacacuggagaacaugccaaagcuaucggcaacugcccuauuuggguuaagaccccucucaaacuggccaaugguacaaaguaccgcccacccgcaaaacuucugaaggagcgaggguuuuucggcgcuauagccggauuuuuggagggcgggugggaaggaaugaucgcggguuggcacggcuauaccagucauggggcccacggaguggcagucgcugccgaccucaagucuacucaggaggcuauuaacaaaaucacgaagaaucugaacuccuuaagcgaacuggaggugaaaaaucuccaaagacuuucgggcgccauggaugaacugcacaacgagauauuggagcuagacgaaaagguagacgaucugagggcagacacaauuucuucccagaucgagcucgccguucugcuuucaaaugaagguaucauuaacagugaggaugaacaucuguuggcucucgagcggaaacugaagaagauguuagggcccagcgcgguggacaucggcaauggauguuucgagaccaaacacaagugcaaccagacuugccuggaucguauugcagccggcaccuuuaaugcuggggaguucucccuaccaacauuugacucucucaacauaaccgccgcaagccugaauggagauggucuugacaaccauacuaucuugcuguacuauucaacagccgcuaguucccucgccgucacgcugaugauugcaaucuucaucguguacaugauuagccgcgauaaugucucuuguucaauaugccuuuga

SEQ ID NO: 148493 - RNA, 1755 nt, Artificial Sequence; identical to SEQ ID NO: 148414
  derived and/or modified sequence opt3 from hemagglutinin__InfluenzaB__ABN50382

SEQ ID NO: 148494 - RNA, 1755 nt, Artificial Sequence; identical to SEQ ID NO: 148414
  derived and/or modified sequence opt3 from hemagglutinin__InfluenzaB__ABN50393

SEQ ID NO: 148495 - RNA, 1755 nt, Artificial Sequence
  derived and/or modified sequence opt3 from hemagglutinin__InfluenzaB__ABN50404
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaagagacaauaacaaaacggccacuaauccgcugacagucgaggugccccacauuuguaccaaggaagaggaucagaucacuguguggggauuccauucugacaacaaaacacagaugaagaaucuguacggugauagcaacccucaaaaguuuaccuccucagcgaauggcgucacgacccacuauguuagucagauugggggauucccagaccagacagaggauggcggucucccccagagcgggaggaucgugguagacuacauggugcaaaaaccuggaaagacuggcaccauagucuaucagcggggcauuuuacugccacagaaaguguggugcgcaucugggcgcuccaagguuaucaaaggaucacuucccuugauuggugaagccgauugucugcacgagaaguacggcgggcuaaacaaaagcaagccguauuacacaggagaacaugcuaaggccaucggcaacugcccuaucugggugaaaacuccccucaagcuggcaaaugguaccaaauaccgaccuccagcuaaacuucugaaggagagaggguuuuucggcgccauugcgggauuuuuggagggcgggugggaaggaaugauagccgguuggcacggcuauacaagucauggggcacacggagucgcuguggccgcugaccucaagucuacccaggaggccaucaacaagauuacuaaaaaucugaacuccuuaagcgaacuggagguaaagaaucuccaaaggcuuucgggcgcaauggaugaacugcacaacgagaucuuggagcuagacgaaaaaguugacgaucugcgggccgacacgauaucuucccagauugagcucgcugugcugcuuucaaaugaagguaucaucaacagugaggaugaacaucuguuggcgcucgagcguaagcugaaaaagauguuagggcccagcgcagucgacauuggcaauggauguuucgagacaaagcacaaaugcaaccagaccugccuggaucgcaucgccgcuggcacuuuuaaugccggggaguucucccuaccaaccuuugacucucucaacauuacagcagccagccugaaugaugacggacuugauaaccauaccauauugcuguacuauucaacugcugccaguucccucgcagugacacugaugaucgcgauuuucaucgucuacaugaucagcagagacaaugugucuuguucaauuugccuuuga

SEQ ID NO: 148496 - RNA, 1755 nt, Artificial Sequence; identical to SEQ ID NO: 148423
  derived and/or modified sequence opt3 from hemagglutinin__InfluenzaB__ABN50415

SEQ ID NO: 148497 - RNA, 1755 nt, Artificial Sequence; identical to SEQ ID NO: 148423
  derived and/or modified sequence opt3 from hemagglutinin__InfluenzaB__ABN50426

SEQ ID NO: 148498 - RNA, 1755 nt, Artificial Sequence
  derived and/or modified sequence opt3 from hemagglutinin__InfluenzaB__ABN50437
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauccuaauccacaaaaguuuacaagcuccgcgaacggggugaccacgcacuaugucucacagauuggaggcuuccccgaccagaccgaggauggugggcucccucagaguggaagaaucguuguggacuacaugaugcaaaagccaggcaaaacaggcacuauaguauaucagaggggaguguuacugccccagaaggucuggugcgcaagcgggaaaucuaaggugauuaaagguucccuuccguugaucggcgaagccgauugucugcaugagaaguacgggggacuaaacaaaucaaagccuuacuauaccggcgaacacgcuaaggccauugguaauugccccaucuggguuaaaacaccacucaagcuggcaaacgggacuaaauaccggccucccgcuaagcugcugaaagagcgcggcuuuuucggagccaucgcgggcuuuuuggaagggggaugggaagguaugauugccggcuggcacggguauaccagccauggagcacacggcguggcugucgccgcugaccucaagaguacacaggaggccauaaauaagaucaccaaaaaccuuaauucuuuauccgaacuggaggugaagaaccuccaacgacuuagcggugcaauggacgaacugcauaaugagauuuuggagcuagaugaaaaaguagacgaucugagagccgacacuaucucgucucagauagagcucgcuguucugcuuuccaacgaagggauuaucaauucagaggaugaacaccuguuggcgcucgagaggaagcugaaaaagauguuaggcccaagugcaguggacaucggaaacggcuguuucgagacgaagcacaaaugcaaucagacaugccuggaucggauugccgcugggaccuuuaacgccggagaguucagccuacccacuuuugacucccucaauaucaccgcagccucucugaacgaugacggucuugauaaucauacaauuuugcuguacuauagcaccgcugccucaagucucgcagucacucugaugcuugcgauauucaucguguacauggucucccgugacaacgugagcuguucuauuugccuguga

SEQ ID NO: 148499 - RNA, 1758 nt, Artificial Sequence
  derived and/or modified sequence opt3 from hemagglutinin__InfluenzaB__ABN50459
augaaggcccugaucgugcuccuuauggucguuaccagcaacgcugacagaauuugcacaggcauaacuuccucuaauucaccccacgugguaaaaacggcaacccagggggaggugaacgucacaggagugaucccucugacuaccacaccaaccaagagucauuucgccaauuugaaagguacuaagacaaggggcaaauuauguccgaagugccugaacuguaccgaucuagacguugcgcucgggcggcccaagugcacgggaaauauuccuagcgcugaaguguccauccugcacgagguccgcccagugacuucuggcuguuuucccauuaugcaugaucgaaccaaaauccgucaacuuccuaaccuguugagagguuacgaacacauaaggcucucgacacauaauguaaucaacgccgagaaggcaccagggggacccuauaaaauuggcacuucaggcagcugcccuaauguuaccaacgggaauggauucuuugccacaauggcuugggcagugccaaagaacgacaauaacaaaaccgccacgaauagucugacuaucgaagucccguacauuuguacagagggugaggaucagaucaccauauggggcuuccacuccgacaacgaaauucagauggcuaagcuguauggggauucuaagccccagaaauuuacuagcuccgccaacggagugacaacccacuacgugucacaaaucggcgguuucccuaaucagacggaggacgggggacucccacagaguggccggauugucguugauuauauggugcagaaguccggcaaaaccgggacaaucacuuaccaacgcggaaucuuacugccccagaagguauggugcgcgucugguagauccaaagugauuaagggcucacuuccuuugauaggggaagcagacugucugcaugagaaauauggaggccuaaacaagagcaagccauacuacaccggugagcacgccaaagcuaucgggaauugccccauuugggucaagacaccgcucaaacuggccaacggcacuaaguauaggccucccgcaaaacuucugaaggaacggggauuuuucggcgcuaucgccggguuuuuggagggagguugggaaggcaugauagcgggguggcauggauacaccagucacggcgcccacgguguggcaguugcugccgaucucaagucuacacaggaggcuauuaauaaaaucaccaagaaccugaauagcuuaagcgaacuggaggugaaaaaccuccagcgccuuucgggggccauggacgagcugcauaaugaaaucuuggagcuagaugaaaaggucgacgaccugcgagcagauacuauuucuucccaaaucgagcucgccgugcugcuuucaaacgaaggcauuauaaauagugaggacgagcaccuguuggcucucgaaagaaaacugaagaagauguuaggaccaagcgcgguagagaucggcaacggguguuucgaaacgaaacauaagugcaaucagacaugccuggauaggauugcagccggaaccuuugacgcuggugaguucucccuaccuacuuuugauucucucaacaucaccgccgcaagccugaaugacgauggccuugacaaccacacaaucuugcuguauuacucaaccgccgcuaguucccucgccguuacucugaugauugcaauauucguggucuauauggugagccgggauaacgucucuuguucaaucugccuuuga

SEQ ID NO: 148500 - RNA, 1758 nt, Artificial Sequence
  derived and/or modified sequence opt3 from hemagglutinin__InfluenzaB__ABN50470
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauaacgaaauucagauggcuaagcuguauggggacucuaaaccccagaaguuuaccagcuccgccaauggagugacuacacacuacgucucacaaaucggcgguuucccuaaccagaccgaggaugggggacugccacagaguggccgcauuguuguggacuauaugguacagaaaagcggcaagacggggaccaucacauaccaaagaggaauccucuuaccccagaaaguguggugcgcgucugguagguccaaggucauuaaaggcucacugccucuuauaggggaagcagauuguuugcacgagaaguauggaggccugaauaagagcaaaccauacuacacuggugagcaugccaaggcuaucgggaacugccccauuugggugaaaaccccgcuaaagcucgccaauggcacaaaauaucggccucccgcaaagcugcuuaaggaacgcggauuuuucggcgcuaucgccggguuucuggagggagguugggaaggcaugauagcgggguggcacggauacacaagucauggcgcccacgguguugcaguggcugccgacuugaaaucuacccaggaggcuauuaacaagaucacuaaaaaucucaacucccugagcgaauuagaggucaagaaucugcagcgacucucgggggccauggaugagcuucacaacgaaauccuggaguuggacgaaaaaguggaugaccuaagagcagacaccauuucuucccaaaucgagcuggccguacuccugucaaaugaaggcauuauaaacagugaggaugagcaucuucuggcuuuggaaaggaagcucaagaaaaugcugggaccaagcgcgguugagaucggcaauggguguuucgaaacuaagcacaaaugcaaccagacgugcuuagaccggauugcagccggaacauuuaaugcuggugaguucucccugccuaccuuugauucucuaaacaucacugccgcaagccucaacgacgauggccuggacaaucauaccauccuuuuguauuacucaacagccgcuaguucccuggccgugacccucaugauugcaauauucgucguguauauggucagccgugauaacgugucuuguucaaucugccuguga

SEQ ID NO: 148501 - RNA, 1755 nt, Artificial Sequence
  derived and/or modified sequence opt3 from hemagglutinin__InfluenzaB__ABN50481
augaaggccaucauugugcugcuccuugucguuaccagcaacgcugacagaauaugcacaggcaucacuuccucuaauucaccccacgugguaaaaacggcaacccagggggaggugaacgucacaggagccauuccucugacuaccacaccaaccaagagucauuucgcgaauuugaaagguacuaagacaaggggcaaauuauguccgaccugcuuuaacuguacggaucuggacguggcucuagggcggcccaugugcguuggaaucacuccuagcgccaaggcauccauucuccacgaagugcgcccagucaccucuggcuguuuccccaucaugcaugaucgaacaaagauacgucaacugccuaaucuucugagagguuacgagaaaaucagguugucgacucagaacgugauugacgccgaaaaggcuccagggggacccuaucggcucggcaccucaggcagcugcccuaaugcaacaaguaaauccggguuuuucgccaccauggcuugggccguaccacgcgauaacaauaagacggcgacuaacccgcugacaguugaggugccccacaucuguaccaaagaagaggaccagauuacugucuggggauuucauucugauaauaagacacagaugaagaaccuguacggugacagcaauccucaaaaauucaccuccucagcaaacggcaucacgacccacuaugugagucagauagggggauuuccagaucagacagaggacggcggucucccccagagcgggagaauuguggucgauuacaugguucaaaagccuggaaaaacuggcaccaucguguaucagaggggcauuuuacugccacagaagguauggugcgccucugggcgguccaaagugaucaagggaucacuucccuugaucggugaagcugacugucugcacgagaaauacggcgggcuaaauaagagcaagccguauuacacaggagaacaugccaaagcaauuggcaacugcccuauaugggucaagacuccccucaaacuggcuaacgguaccaaguaccgcccuccagccaaacuucugaaggagcgaggguucuuuggcgcgaucgccggauucuuggagggcgggugggaaggaaugauugcagguuggcacggcuauacaagucauggggcucacggaguggccguugcugccgaucucaagucuacccaggaggcaaucaauaaaauaacuaagaacuuaaauucccugagcgaacuggaggugaaaaaccuccaaagacuuucgggcgccauggacgaacugcacaaugagauuuuggagcuagacgaaaaggucgaugaccugagggcugauacgaucucuucccagaucgagcucgcggugcugcuuucaaacgaagguauuaucaauagugaggacgaacaucuguuggcacucgagcggaaacugaagaagauguuagggcccagcgccguagauauuggcaacggauguuuugagacaaaacacaagugcaaucagaccugccuggaccguauagcugccggcacuuucaacgcaggggaauuuucccuaccaaccuucgauucucucaauaucacagccgcuagccugaacgacgauggacuugacaaucauaccauuuugcuguacuauucaacugccgcaaguucccucgcgguuacacugaugaucgcuaucuucauuguguacaugauaagccgcgauaacgucucuuguucaaucugccuuuga

SEQ ID NO: 148502 - RNA, 1755 nt, Artificial Sequence
  derived and/or modified sequence opt3 from hemagglutinin__InfluenzaB__ABN50503
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggagucacuccuagcgcuaaggccuccauccuccacgaagugcgcccaguaaccucuggcuguuuucccauuaugcaugaucgaacaaagauccgucaacugccuaaucuucugagagguuacgagaaaauaagguugucgacucagaacguuaucaaugcagaaaaggccccagggggacccuaucggcucggcaccucaggcagcugcccuaacgcuacaagucgcuccggguucuuugcaaccauggccugggcugugccaaaagacaauaacaagacggccacuaauccgcugacagucgaggugccccacauuuguaccaaagaagaggaucagaucacuguguggggauuccauucugacgauaagacacagaugaagaaccuguacggugacagcaauccucaaaaauuuaccuccucagcgaacggcgucacgacccacuauguuagucagauugggggauucccagaucagacagaggacggcggucucccccagagcgggagaaucgugguagauuacauggugcaaaagccuggaaaaacuggcaccauagucuaucagaggggcauuuuacugccacagaagguguggugcgcaucugggcgguccaaaguuaucaagggaucacuucccuugauuggugaagccgacugucugcacgagaaauacggcgggcuaaauaagagcaagccguauuacacaggagaacaugcuaaagccaucggcaacugcccuaucugggugaagacuccccucaaacuggcaaacgguaccaaguaccgcccuccagcuaaacuucugaaggagcgaggguuuuucggcgccauugcgggauuuuuggagggcgggugggaaggaaugauagccgguuggcacggcuauacaagucauggggcacacggagucgcuguggccgcugaucucaagucuacccaggaggccaucaauaaaauuacuaagaacuuaaauucccugagcgaacuggagguuaaaaaccuccaaagacuuucgggcgcaauggacgaacugcacaaugagaucuuggagcuagacgaaaagguagaugaccugagggccgauacgauaucuucccagauugagcucgcugugcugcuuucaaacgaagguaucaucaauagugaggacgaacaucuguuggcgcucgagcggaaacugaagaagauguuagggcccagcgcagucgauauuggcaacggauguuucgagacaaaacacaagugcaaucagaccugccuggaccguaucgccgcuggcacuuuuaacgccggggaguucucccuaccaaccuuugauucucucaauauuacagcagccagccugaacgacgauggacuugacaaucauaccauauugcuguacuauucaacugcugccaguucccucgcagugacacugaugaucgcgauuuucaucgucuacaugaucagccgcgauaacgugucuuguucaauuugccuuuga

SEQ ID NO: 148503 - RNA, 1755 nt, Artificial Sequence
  derived and/or modified sequence opt3 from hemagglutinin__InfluenzaB__ABN50514
augaaggccaucauugugcugcucauggucgcuaccagcaacgcagacagaauaugcacaggcaucacuuccucuaauucaccccacguugugaaaacggccacccagggggagguaaacgugacaggagucauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaauccggguucuuugccaccauggcuugggccguaccaaaggacaauaacaaaaaugcgacgaacccgcugacuguugaggugcccuaugucuguacagaaggagaggaucagauuaccgugugggguuuccauucugacaauaagccucagaugaaaaaccuguacggcgauagcaauccacaaaaguuuacuuccucagcaaacggggugacaacccacuaugucagucagaucggaggcuuccccgaccagacggaggauggugggcucccucagagcggaagaauuguuguggacuacaugguacaaaagccaggcaaaaccggcacaaucguguaucagaggggagucuuacugccccagaagguguggugcgccucugggcgguccaaaguuauaaaggguucacuuccguugauuggcgaagcugauugucugcaugagaaauacgggggacuaaacaagagcaaaccuuacuauacuggcgaacacgccaaggcaaucgguaauugccccauuugggugaagaccccacucaaacuggcuaacgggacaaaguaccgcccucccgccaaacuucugaaggagcgaggcuuuuucggagcgaucgccggcuuuuuggaagggggaugggaagguaugaucgcaggcuggcacggguauacuucccauggagcucacggcgucgccguggcugccgaccucaaaucuacccaggaggcaauuaauaagauaacaaagaaccugaauaguuuaagcgaacuggagguuaaaaaccuccaaagacuuucgggugccauggacgaacugcaugaugagaucuuggagcuagacgaaaagguagaugaccugagggcugauaccauuucuucccagaucgagcucgcggugcugcuuucaaaugaagggauaauuaacagugaggacgaacaccuguuggcacucgagcggaaacugaagaaaauguuaggcccaagcgccgucgauaucggaaauggcuguuucgagacuaagcacaagugcaaccagacgugccuggaccguaucgcugccgggacauuuaaugcaggagaguucucccuacccaccuuugauucucucaacauuacugccgcuagccugaaugacgauggucuugacaaccauaccaucuugcuguacuauucaacagccgcaaguucccucgcggugacccugaugcuugcuauuuucauagucuacauggugagccgcgacaauguuucuuguucaaucugccuguga

SEQ ID NO: 148504 - RNA, 1755 nt, Artificial Sequence
  derived and/or modified sequence opt3 from hemagglutinin__InfluenzaB__ABN50525
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuuucuaccauggcaugggccguuccaaaggacaauaacaaaaaugcuacgaacccgcugacuguggagguccccuauguguguacagaaggagaggaucagauuaccgugugggguuuccauagcgacaauaagacucagaugaaaaaccuguacggcgauuccaauccucaaaaguuuacaucaagugccaacggggucaccacgcacuauguuagccagaucggaggcuucccagaccagaccgaggauggugggcucccccagucuggaagaauugugguagacuacauggugcaaaagccuggcaaaacaggcacuaucgucuaucagaggggaguguuacugccacagaagguuuggugcgcguccgggcggucaaaagugauaaaggguagccuucccuugauuggcgaagcagauugucugcaugagaaauacgggggacuaaacaagaguaaaccguacuauaccggcgaacacgccaaggcuaucgguaauugcccuauuugggucaagacaccccucaaacuggccaacgggacuaaguaccgcccuccagcaaaacuucugaaggagcgaggcuuuuucggagcuaucgccggcuuuuuggaagggggaugggaagguaugaucgcgggcuggcacggguauaccucucauggagcccacggcguggcaguagcugccgaccucaaauccacacaggaggcuauuaauaagauaaccaagaaccugaauagcuuaucggaacuggagguuaaaaaccuccaaagacuuucuggugccauggacgaacugcauaaugagaucuuggagcuagaugaaaagguggacgaucugagggcagacacuauuuccucacagaucgagcucgccguccugcuuaguaacgaagggauaauuaauagcgaggaugaacaccuguuggcucucgagcggaaacugaagaaaauguuaggccccuccgcgguggacaucggaaacggcuguuucgagacgaagcacaagugcaaucagacaugccuggaucguaucgcagccgggaccuuuaacgcuggagaguucucucuaccaacuuuugacagccucaauauuaccgccgcaucacugaacgaugacggucuugauaaucauacaaucuugcuguacuauaguaccgccgcuuccagccucgccgucacucugaugcuugcaauuuucauaguguacaugguuucucgcgacaacgugucauguaguaucugccuguga

SEQ ID NO: 148505 - RNA, 1758 nt, Artificial Sequence
  derived and/or modified sequence opt3 from hemagglutinin__InfluenzaB__ABN50536
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaagaggcaccagggggacccuauaaaaucggcacaucaggcagcugcccuaacguuacuaaugggaacggauucuuugccaccauggcuugggcagugccaaagaaugaaaacaauaaaacagccaccaacagucucacgauugaggucccguacaucuguacugagggugaagaccagauaacaguguggggcuuccauuccgauaacgagauucagauggcuaagcuguauggggacucuaagccccagaaauuuaccagcuccgccaauggagugacuacacacuacgucucacaaaucggcgguuucccuaaccagaccgaagaugggggacugccacagaguggccgcauuguuguggacuauaugguacagaagaguggcaaaacggggaccaucacauaccaaagaggaauccucuuaccccagaagguguggugcgcgucugguagguccaaagucauuaagggcucacugccucuuauaggggaggcagauuguuugcacgagaaauauggaggccugaauaagagcaagccauacuacacuggugaacaugccaaagcuaucgggaacugccccauuugggugaagaccccgcuaaaacucgccaauggcacaaaguaucggccucccgcaaaacugcuuaaggagcgcggauuuuucggcgcuaucgccggguuucuggaaggagguugggagggcaugauagcgggguggcacggauacacuagccauggcgcccacgguguugcaguggcugccgacuugaagucuacccaggaagcuauuaacaaaaucacaaagaaucucaacucccugagcgaguuagaggucaaaaaucugcagcgacucucgggggccauggaugaacuucacaacgagauccuggaauuggacgagaagguggaugaccuaagagcagacaccauuucuucccaaaucgaacuggccguacuccugucaaaugagggcauuauaaacagugaggaugaacaucuucuggcuuuggagaggaaacucaagaagaugcugggaccaagcgcgguugaaaucggcaauggguguuucgagacuaaacacaagugcaaccagacgugcuuagaccggauugcagccggaacauuuaaugcuggugaguucucccugccuaccuuugauucucuaaacaucacugccgcaagccucaacgacgauggccuggacaaucauaccauccuuuuguauuacucaacagccgcuaguucccuggccgugacccucaugauugcaauauucgucguguauauggucagccgugauaacgugucuuguucaaucugccuguga

SEQ ID NO: 148506 - RNA, 1758 nt, Artificial Sequence
  derived and/or modified sequence opt3 from hemagglutinin__InfluenzaB__ABN50547
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccaaagaacgacaauaacaagaccgccacgaauagucucacuauugaggucccguacaucuguacagaaggugaggaucagcugaccguguggggcuuccacuccgacaacgagaaccagauggcuaagcuguauggggauucuaaaccccagaaguuuacuagcuccgccaauggagugacaacccacuacgucucacaaauaggcgguuucccuaaccagacggaagacgggggacucccacagaguggccggauuguuguggauuauaugguacagaaaagcggcaagaccgggacaaucacuuaccaacgcggaauuuuacugccccagaaaguguggugcgcgucugguagauccaaggucaucaaaggcucacuuccuuugaucggggaggcagacugucugcaugaaaaguauggaggccuaaauaagagcaaaccauacuacaccggugagcacgccaaggcuauugggaacugccccauaugggugaaaacaccgcucaagcuggccaauggcacuaaauauaggccucccgcaaaacuucugaaggagcggggauuuuucggcgcuaucgccggguuuuuggaaggagguugggagggcaugauugcgggguggcauggauacaccagucacggcgcccacgguguugcaguggcugccgaucucaaaucuacacaggaagcuaucaacaagauaaccaaaaaucugaacuccuuaagcgagcuggaagucaagaaucuccagcgccuuucgggggccauggacgagcugcauaacgagauuuuggaacuagaugagaaaguggacgaccugcgagcagauacuaucucuucccaaaucgaacucgccguacugcuuucaaaugagggcauuaucaacagugaagacgagcaccuguuggcucucgagagaaagcugaagaaaauguuaggaccaagcgcgguugaaauuggcaauggguguuucgagacgaagcauaaaugcaaccagacaugccuggauaggauagcagccggaaccuuugacgcuggugaguucucccuaccuacuuuugauucucucaauaucaccgccgcaagccugaacgacgauggccuugacaaccacacaauuuugcuguauuacucaaccgccgcuaguucccucgccgugacucugaugaucgcaaucuucgucguguauauggucagccgggauaaugugucuuguucaauuugccuuuga

SEQ ID NO: 148507 - RNA, 1758 nt, Artificial Sequence
  derived and/or modified sequence opt3 from hemagglutinin__InfluenzaB__ABN50558
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccaaagaacgacaauaacaagaccgccacgaauagucucacuauugaggucccguacaucuguacagaaggugaggaucagauaaccguguggggcuuccacuccgacaaggagacucagauggcuaaacuguauggggauucuaagccccagaaauuuacaagcuccgccaacggagugaccacgcacuacgucucacaaauuggcgguuucccuaaccagaccgaagacgggggacugccacagaguggccggaucguuguggauuauaugaugcagaaaagcggcaaaacagggacuauuaccuaccaacgcggaauccucuuaccccagaagguauggugcgcgucugguagauccaaagugaucaagggcucacugccucuuauuggggaggcagacuguuugcaugaaaaguauggaggccugaauaaaagcaagccauacuacacaggugagcacgccaaagcuauagggaacugccccaucugggucaagacuccgcuaaaacucgccaauggcaccaaguauaggccucccgcaaagcugcuuaaagagcggggauuuuucggcgcuauugccggguuucuggaaggagguugggagggcaugaucgcgggguggcauggauacacaagucacggcgcccacgguguggcaguugcugccgauuugaagucuacccaggaagcuauaaacaaaauuacuaagaaucucaacucccugagcgaguuagaagugaaaaaucugcagcgccucucgggggccauggacgagcuucauaacgagauccuggaauuggaugagaaggucgacgaccuacgagcagauacgaucucuucccaaauugaacuggccgugcuccugucaaaugagggcaucauuaacagugaagacgagcaccuucuggcuuuggagagaaagcucaaaaagaugcugggaccaagcgcgguagaaauaggcaauggguguuucgagacaaaacauaagugcaaccagaccugcuuagauaggaucgcagccggaacuuuugacgcuggugaguucucccugccuaccuuugauucucuaaauauuacagccgcaagccucaacgacgauggccuggacaaucacaccauccuuuuguauuacucaacugccgcuaguucccuggccguuacacucaugaucgcaauuuucguggucuauauggugagccgggauaacgucucuuguucaauaugccuguga

SEQ ID NO: 148508 - RNA, 1755 nt, Artificial Sequence; identical to SEQ ID NO: 148423
  derived and/or modified sequence opt3 from hemagglutinin__InfluenzaB__ABN50569

SEQ ID NO: 148509 - RNA, 1758 nt, Artificial Sequence; identical to SEQ ID NO: 148435
  derived and/or modified sequence opt3 from hemagglutinin__InfluenzaB__ABN50580

SEQ ID NO: 148510 - RNA, 1758 nt, Artificial Sequence
  derived and/or modified sequence opt3 from hemagglutinin__InfluenzaB__ABN50591
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauaacgaagcucagauggccaagcuguauggggacucuaaaccccagaaguuuaccagcuccgcgaauggagugacuacacacuacgucucacaaauuggcgguuucccuaaccagaccgaggaugggggacugccacagaguggccgcaucguuguggacuauaugguacagaaaagcggcaagacggggaccauuacauaccaaagaggaauccucuuaccccagaaaguguggugcgcaucugguagguccaaggucaucaaaggcucacugccucuuauuggggaagccgauuguuugcacgagaaguauggaggccugaauaagagcaaaccauacuacacuggugagcaugcuaaggccauagggaacugccccaucugggugaaaaccccgcuaaagcucgcaaauggcacaaaauaucggccucccgcuaagcugcuuaaggaacgcggauuuuucggcgccauugcgggguuucuggagggagguugggaaggcaugaucgccggguggcacggauacacaagucauggcgcacacgguguugcuguggccgcugacuugaaaucuacccaggaggccauaaacaagauuacuaaaaaucucaacucccugagcgaauuagaggucaagaaucugcagcgacucucgggggcaauggaugagcuucacaacgaaauccuggaguuggacgaaaaaguggaugaccuaagagccgacaccaucucuucccaaauugagcuggcuguacuccugucaaaugaaggcaucauuaacagugaggaugagcaucuucuggcguuggaaaggaagcucaagaaaaugcugggaccaagcgcaguugagauaggcaauggguguuucgaaacuaagcacaaaugcaaccagacgugcuuagaccggaucgccgcuggaacauuuaaugccggugaguucucccugccuaccuuugauucucuaaacauuacugcagccagccucaacgacgauggccuggacaaucauaccauccuuuuguauuacucaacagcugccaguucccuggcagugacccucaugaucgcgauuuucgucguguauauggucagccgugauaacgugucuuguucaauaugccuguga

SEQ ID NO: 148511 - RNA, 1758 nt, Artificial Sequence
  derived and/or modified sequence opt3 from hemagglutinin__InfluenzaB__ABN50602
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcaugggaacgaucccuagcgcuaaagccuccauucuccacgaagugaagccagucacuucuggcuguuuucccaucaugcaugaucgcaccaaaauacgacaacugccuaaucuucugcgugguuacgagaacaucagauugucgacacacaaugugauuaacgcagaaacugccccagggggacccuauaagaucggcaccucaggcagcugcccuaauauuacaaacgggaauggauucuuugcuaccauggcaugggccguaccgaaaaacgacaauaacaagacggcuacuaauccacucacaguugaggugcccuacaucuguaccgaaggugaggaucagauaacugucuggggcuuccauagugacaacgagacacagauggugaagcuguauggggauuccaaaccucagaaguuuaccucuagcgccaacggagugacggcgcacuacgucucccaaauuggcgguuucccaaaucaggcagaagacgggggacugccccagucaggcaggaucguuguggauuauaugguacagaaaaguggcaagaccgggacaauuacuuaccaacggggaauccucuuaccucagaaaguguggugcgccagcggucgcucuaaggucaucaaaggcucccugccacuuauuggggaggcugacuguuugcacgaaaaguauggaggccugaacaagucaaaacccuacuacaccggugagcaugccaaggcaauagggaauugcccgaucugggugaaaacaccucuaaagcucgcuaacggcacuaaauauagacccccagccaagcugcuuaaggagaggggauuuuucggcgcgauugccggguuucuggaaggagguugggagggcaugaucgcaggguggcacggauacaccagccauggcgcucacgguguugccguggcugccgauuugaaaaguacacaggaagcaauaaauaagauuaccaaaaaccucaauucucuguccgaguuagaagucaagaaccugcagcggcucagcggggccauggacgagcuucacaaugagauccuggaauuggaugagaaaguggacgaccuacgcgcugauacuaucucgucucaaauugaacuggcgguacuccuguccaacgagggcaucauuaauucagaagacgagcaucuucuggcauuggagcgaaagcucaagaaaaugcugggaccuagugccguugauauaggcaacggguguuucgaaacgaagcacaaaugcaaucagacaugcuuagacagaaucgcugccggaaccuuuaacgccggugaguucagccugcccacuuuugauucccuaaauauuaccgcagcuucucucaacgacgauggccuggacaaccauacaauccuuuuguauuacagcaccgccgcaucaagucuggcggugacucucaugaucgcuauuuucauagucuauaugguguccagggauaaugucagcuguucuaucugccuguga

SEQ ID NO: 148512 - RNA, 1752 nt, Artificial Sequence
  derived and/or modified sequence opt3 from hemagglutinin__InfluenzaB__ABN50624
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagaauauuagguugucgacacacaacgugaucaaugcagaacgggccccagggggacccuaucgccucggcacuucaggcagcugcccuaacguaaccaguaaauccggguucuuugcuacaauggcaugggccguuccaagagacaauaagaccgcuacgaacccgcugacuguggagguccccuacauuuguacaaaaggagaagaucagaucaccgugugggguuuccauucugacaauaagaaccagaugaaaaaucuguauggcgauagcaacccucagaaguuuacuuccucagugaacggggucacaacccacuacguuagucaaauaggaggcuucccaaaucagacggaggacggugggcucccccagagcggaaggauugugguagauuauauggugcagaagccuggcaaaaccggcacaaucgucuaccaacgcgggguguuacugccacagaagguuuggugcgccucuggacgguccaaagugauuaaggguucacuucccuugaucggcgaggcggacugucugcacgaaaaauaugggggacuaaacaagagcaaaccguacuacacuggcgagcaugcaaaggccaucgguaauugcccuauuugggucaagaccccacucaaacuggcuaacgggacaaaguaucgacccccugccaaacuucugaaggaaagaggcuuuuucggagcaauagcuggcuuuuuggaagggggaugggaggguaugaucgccggcuggcacggguacacuucccauggagcgcacggcguggccguagcagcugaucucaaaucuacccaggaggccauuaauaagaucacaaagaaccugaauaguuuaagcgagcuggaaguuaaaaaccuccagaggcuuucgggugcuauggacgagcugcacaaugaaauauuggagcuagaugagaagguggacgaccugcgggccgauaccauuucuucccaaaucgaacucgcaguccugcuuucaaacgaggggaucauuaauagugaagacgagcaucuguuggcccucgaacguaaacugaagaaaauguuaggccccagcgcuguggauaucggaaacggcuguuucgagacuaagcacaagugcaaucagacgugccuggaccgcauugcggcagggacauuuaacgccggagaguucucccuaccaaccuuugauucucucaauauaacugcugccagccugaacgacgauggucuugacaaccauaccaucuugcuguauuacucaacagcagccaguucccucgcugucacccugaugauugccaucuucaucguguauaugguuagcagagauaaugugucuuguucaauuugccuuuga

SEQ ID NO: 148513 - RNA, 1752 nt, Artificial Sequence
  derived and/or modified sequence opt3 from hemagglutinin__InfluenzaB__ABN50635
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacagcaaaacucagaugaagaaccuguauggcgauuccaauccucagaaauuuacaucaagugccaacggggugaccacgcacuacgucagccaaauaggaggcuucccaaaucagaccgaggacggugggcucccccagucuggacggauuguuguggauuauaugguacagaagccuggcaagacaggcacuaucguguaccaacgcggggucuuacugccacagaaaguguggugcgcguccggacgaucaaagguuauuaaagguagccuucccuugaucggcgaggcagacugucugcaugaaaaguaugggggacuaaacaaaaguaagccguacuacaccggcgagcacgccaaagcuaucgguaacugcccuauuugggugaagacaccccucaagcuggccaaugggacuaaauauagaccuccagcaaaacuucugaaggaaaggggcuuuuucggagcuauagccggcuuuuuggaagggggaugggaggguaugaucgcgggcuggcauggguacaccucucacggagcccacggcgucgcaguggcugccgaucucaaguccacacaggaggcuauuaacaaaaucaccaagaaucugaacagcuuaucggagcuggaaguaaagaaucuccagcggcuuucuggugccauggacgagcugcauaacgaaauauuggagcuagaugagaaaguugacgaccugcgugcagauacuauuuccucacaaaucgaacucgccgugcugcuuaguaaugaggggaucauuaacagcgaagacgagcaccuguuggcucucgaacgcaagcugaaaaagauguuaggccccuccgcggucgauaucggaaauggcuguuucgagacgaaacauaagugcaaccagacaugccuggacagaauugcagccgggaccuuuaaugcuggagaguucucucuaccaacuuuugauagccucaacauaaccgccgcaucacugaaugacgauggucuugacaaccacacaaucuugcuguauuacaguaccgccgcuuccagccucgccgugacucugaugauugcaaucuucaucgucuauauggugucuagggauaauguuucauguaguauuugccuuuga

SEQ ID NO: 148514 - RNA, 1752 nt, Artificial Sequence
  derived and/or modified sequence opt3 from hemagglutinin__InfluenzaB__ABN50646
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacaacaaaaaucagaugaagaaccuguauggcgauagcaauccucagaaauuuacuuccucagccaacggggugacaacccacuacgucagucaaauaggaggcuucccaaaccagacggaggacggugggcucccccagagcggacggauuguuguggauuauaugguacagaagccuggcaagaccggcacaaucguguaccaacgcggggucuuacugccacagaaaguguggugcgcgucuggacgauccaagguuauuaaagguucacuucccuugaucggcgaggcagacugucugcaugaaaaguaugggggacuaaauaaaagcaagccguacuacacuggcgagcacgccaaagcuaucgguaacugcccuauuugggugaagacuccccucaagcuggccaaugggacaaaauauagaccuccagcaaaacuucugaaggaaaggggcuuuuucggagcuauagccggcuuuuuggaagggggaugggaggguaugaucgcgggcuggcauggguacaccagucacggagcccacggcgucgcaguggcugccgaucucaagucuacccaggaggcuauuaacaaaaucacaaagaaucugaacuccuuaagcgagcuggaaguaaagaaucuccagcggcuuucgggugccauggacgagcugcauaacgaaauauuggagcuagaugagaaaguugacgaccugcgugcagauaccauuucuucccaaaucgaacucgccgugcugcuuucaaaugaggggaucauuaacagugaagacgagcaccuguuggcucucgaacgcaagcugaaaaagauguuaggccccagcgcggucgauaucggaaauggcuguuucgagacuaaacauaagugcaaccagacgugccuggacagaauugcagccgggacauuuaaugcuggagaguucucccuaccaaccuuugauucucucaacauaacugccgcaagccugaaugacgauggucuugacaaccacaccaucuugcuguauuacucaacagccgcuaguucccucgccgugacccugaugauugcaaucuucaucgucuauauggugagcagggauaacguuucuuguucaauuugccuuuga

SEQ ID NO: 148515 - RNA, 1752 nt, Artificial Sequence
  derived and/or modified sequence opt3 from hemagglutinin__InfluenzaB__ABN50657
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaaucacgccuagcgcuaaggccuccauucuccacgaaguccgcccagugacuucuggcuguuuucccaucaugcaugaucgaaccaagauacgucaacugccuaaccuucugagagguuacgagaauaucagguugucgacacagaacguaauuaaugcagaaaaagccccagggggacccuaucggcucggcacuucaggcagcugcccuaacguuaccagucgcacaggguucuuugcuaccauggcaugggccgugccaagagacaauaagacggcuacuaacccgcugacagucgaggugcccuacaucuguaccaaaggagaagaucagauuacugugugggguuuccacuccgacaauaagacacagaugaaaaaccuguauggcgauucuaauccucaaaaguuuaccagcuccgccaacggggucacgacccauuacguuucacagaucggaggcuucccagaccagacagaggauggugggcucccccagaguggaaggauagugguagacuauauggugcaaaagccuggcaaaacuggcaccauugucuaccagcgggggaucuuacugccacagaagguguggugcgcgagcggacgcucuaaaguuauuaaggguucccuucccuugaucggcgaggcagauugucugcacgaaaaauaugggggacuaaacaagucaaaaccguacuacacaggcgagcacgccaaggcuaucgguaauugcccuauuugggugaagacuccccucaaacuggccaacgggaccaaguaucgaccuccagcaaaacuucugaaggaaagaggcuuuuucggagcuauagccggcuuuuuggaagggggaugggaggguaugaucgcgggcuggcauggguacacaagccacggagcccauggcgucgcaguggcugccgaccucaaaaguacccaggaggcuauuaauaagaucacuaagaacuuaaauucucuguccgagcuggaaguuaaaaaccuccaaaggcuuagcggugccauggaugagcugcacaaugaaauauuggagcuagacgagaagguagacgaucugcgggcagacacgauuucgucucagaucgaacucgccgugcugcuuuccaacgaggggaucauuaauucagaagaugagcaccuguuggcucucgaacguaaacugaagaaaauguuaggccccagugcggucgacaucggaaacggcuguuucgagacaaagcauaagugcaaucagaccugccuggaucgcauugcagccgggacuuuuaacgcuggagaguucagccuaccaaccuuugacucccucaauauaacagccgcaucucugaacgaugacggucuugauaaucacaccaucuugcuguauuacagcacugccgcuucaagucucgccgugacacugaugauugcaaucuucaucgucuauaugguguccagagacaacguuagcuguucuauuugccuuuga

SEQ ID NO: 148516 - RNA, 1755 nt, Artificial Sequence
  derived and/or modified sequence opt3 from hemagglutinin__InfluenzaB__ABN50679
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacaauaacaagacggccacuaauccgcugacaguggagguccccuacauuuguaccaaaggagaagaucagaucacugugugggguuuccacucugacgauaagacacagaugaaaaaccuguauggcgacagcaauccucaaaaguuuaccuccucagcgaacggggugacgacccauuacgucagucagauuggaggcuucccagaucagacagaggacggugggcucccccagagcggaaggaucguuguggauuauaugguacaaaagccuggcaaaacuggcaccauaguguaccagcgcggggucuuacugccacagaagguguggugcgcaucuggacgguccaaaguuauuaaggguucacuucccuugaucggcgaggccgacugucugcacgaaaaauaugggggacuaaacaagagcaaaccguacuacacaggcgagcacgcuaaggccauugguaauugcccuaucugggugaagacuccccucaaacuggcaaacgggaccaaguaucgaccuccagcuaaacuucugaaggaaagaggcuuuuucggagccaucgcgggcuuuuuggaagggggaugggaggguaugauugccggcuggcauggguacacaagucacggagcacauggcgucgcuguggccgcugaucucaaaucuacccaggaggccauaaauaagaucacuaagaacuuaaauucccugagcgagcuggaaguuaaaaaccuccaaaggcuuucgggugcaauggacgagcugcacaaugaaauuuuggagcuagacgagaagguagaugaccugcgggccgauacgaucucuucccagauagaacucgcugugcugcuuucaaacgaggggauuaucaauagugaagacgagcaccuguuggcgcucgaacguaaacugaagaaaauguuaggccccagcgcagucgauaucggaaacggcuguuucgagacaaagcauaagugcaaucagaccugccuggaccgcauugccgcugggacuuuuaacgccggagaguucucccuaccaaccuuugauucucucaauaucacagcagccagccugaacgacgauggucuugacaaucacaccauuuugcuguauuacucaacugcugccaguucccucgcagugacacugaugauagcgaucuucauugucuauauggugagcagagauaacguuucuuguucaaucugccuuuga

SEQ ID NO: 148517 - RNA, 1755 nt, Artificial Sequence
  derived and/or modified sequence opt3 from hemagglutinin__InfluenzaB__ABN50690
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacaauaacaagacggccacuaauccgcugacaguggagguccccuacguguguaccgaaggagaggaucagauuacugugugggguuuccacucugacaacaaaacacagaugaagaaucuguauggcgauagcaacccucaaaaauuuaccuccucagcgaacggggucacgacccauuacguuagucagaucggaggcuucccagaccagacagaggauggugggcucccccagagcggaaggauugugguagacuauauggugcaaaagccuggcaagacuggcaccaucgucuaccagcgcgggguguuacugccacagaaaguuuggugcgcaucuggacgguccaaggugauaaaagguucacuucccuugauuggcgaagccgauugucugcacgagaaguaugggggacuaaauaaaagcaagccguacuacacaggcgaacacgcuaaagccaucgguaacugcccuauuugggucaagacuccccucaagcuggcaaaugggaccaaauaucgaccuccagcuaaacuucugaaggagagaggcuuuuucggagccaucgcgggcuuuuuggaagggggaugggaagguaugaucgccggcuggcauggguacacaagucacggagcacauggcguggcuguagccgcugaccucaagucuacccaggaggccauuaacaaaauaacuaagaaucugaacuccuuaagcgaacuggagguuaagaaucuccaaaggcuuucgggugcaauggaugaacugcacaacgagaucuuggagcuagacgaaaaaguggacgaucugcgggccgacacgauuucuucccagaucgagcucgcuguccugcuuucaaaugaagggauaauuaacagugaggaugaacaccuguuggcgcucgagcguaagcugaaaaagauguuaggccccagcgcaguggacaucggaaauggcuguuucgagacaaaacauaagugcaaccagaccugccuggaucgcaucgccgcugggacuuuuaaugccggagaguucucccuaccaaccuuugacucucucaacauuacagcagccagccugaaugaugacggucuugauaaccacaccaucuugcuguauuacucaacugcugccaguucccucgcagucacacugaugauugcgauauucaucguguauaugguuagcagagacaacgugucuuguucaauuugccuuuga

SEQ ID NO: 148518 - RNA, 1752 nt, Artificial Sequence
  derived and/or modified sequence opt3 from hemagglutinin__InfluenzaB__ABN50701
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaaucacgccuagcgcuaaggccuccauucuccacgaaguccgcccagugacuucuggcuguuuucccaucaugcaugaucgaaccaagauacgucaacugccuaaccuucugagagguuacgagaauaucagguugucgacacagaacguaauuaaugcagaaaaagccccagggggacccuaucggcucggcacuucaggcagcugcccuaacguuaccagucgcacaggguucuuugcuaccauggcaugggccgugccaagagacaauaagacggcuacuaacccgcugacagucgaggugcccuacaucuguaccaaaggagaagaucagauuacugugugggguuuccacuccgacaauaaggcccagaugaaaaaccuguauggcgauucuaauccucaaaaguuuacaagcuccgcgaacggggucaccacgcauuacguuucacagaucggaggcuucccagaccagaccgaggauggugggcucccccagaguggaaggauagugguagacuauauggugcaaaagccuggcaaaacaggcacuauugucuaccagcgggggaucuuacugccacagaagguguggugcgcaagcggacgcucuaaaguuauuaaggguucccuucccuugaucggcgaggccgauugucugcacgaaaaauaugggggacuaaacaagucaaaaccguacuacaccggcgagcacgcuaaggccaucgguaauugcccuauuugggugaagacaccccucaaacuggcaaacgggacuaaguaucgaccuccagcuaaacuucugaaggaaagaggcuuuuucggagccauagcgggcuuuuuggaagggggaugggaggguaugaucgccggcuggcauggguacaccagccacggagcacauggcgucgcuguggccgcugaccucaaaaguacacaggaggccauuaauaagaucaccaagaacuuaaauucucuguccgagcuggaaguuaaaaaccuccaaaggcuuagcggugcaauggaugagcugcacaaugaaauauuggagcuagacgagaagguagacgaucugcgggccgacacuauuucgucucagaucgaacucgcugugcugcuuuccaacgaggggaucauuaauucagaagaugagcaccuguuggcgcucgaacguaaacugaagaaaauguuaggccccagugcagucgacaucggaaacggcuguuucgagacgaagcauaagugcaaucagacaugccuggaucgcauugccgcugggaccuuuaacgccggagaguucagccuaccaacuuuugacucccucaauauaaccgcagccucucugaacgaugacggucuugauaaucacacaaucuugcuguauuacagcaccgcugccucaagucucgcagugacucugaugauugcgaucuucaucgucuauaugguguccagagacaacguuagcuguucuauuugccuuuga

SEQ ID NO: 148519 - RNA, 1755 nt, Artificial Sequence; identical to SEQ ID NO: 148517
  derived and/or modified sequence opt3 from hemagglutinin__InfluenzaB__ABN50712

SEQ ID NO: 148520 - RNA, 1755 nt, Artificial Sequence
  derived and/or modified sequence opt3 from hemagglutinin__InfluenzaB__ABN50723
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugagggguacuaaaacacggggcaaguuguguccgaccugcuuaaacuguacggaucuggacguugcgcuagggcgccccaugugcgugggaacuaccccuagcgcuaaagccuccauccuccacgaaguccgaccagugacaucuggcuguuuucccauuaugcaugaucguacuaagaucagacaacugccuaaucuucugagggguuacgagaagauacgguugucgacccagaacguaaucaaugcagaaaaagccccagggggacccuaucgccucggcacaucaggcagcugcccuaacgcuaccaguagauccggguucuuugcaacgauggccugggcuguuccaagggacaauaacaagacugccacaaauccgcugaccguggagguccccuacauuuguacuaaagaagaggaucagaucacaguguggggauuccacucugacaacaagacccagaugaaaaaucuguauggugauagcaacccucaaaaguuuacguccucagcgaauggcgugaccacacauuacgucagucagauugggggauucccagaccagacugaggauggcggucucccccagagcgggcggaucguuguggacuauaugguacaaaagccuggaaaaaccggcacaauaguguaccagcgcggcauuuuacugccacagaaggucuggugcgcaucugggcgauccaaagugaucaagggaucacuucccuugauuggugaagccgauugucugcacgagaaauauggcgggcuaaacaagagcaaaccguacuacacuggagaacacgcuaaggccaucggcaacugcccuaucuggguuaagaccccacucaaacuggcaaaugguacaaaguauagacccccugcuaaacuucugaaggagaggggguuuuucggcgccauugcgggauuuuuggagggcgggugggaaggaaugauagccgguuggcauggcuacaccagucacggggcacauggaguggcugucgccgcugaccucaaaucuacucaggaggccaucaacaagauuacgaagaaucugaacuccuuaagcgaacuggaggugaaaaaucuccaacggcuuucgggcgcaauggaugaacugcacaacgagaucuuggagcuagacgaaaagguagacgaucugcgugccgacacaauaucuucccagauugagcucgcuguucugcuuucaaaugaagguaucaucaacagugaggaugaacaccuguuggcgcucgagcgcaaacugaagaaaauguuagggcccagcgcaguggacauuggcaauggauguuucgagaccaagcauaagugcaaccagacuugccuggauagaaucgccgcuggcaccuuuaaugccggggaguucucccuaccaacauuugacucucucaacauuaccgcagccagccugaaugaugacggacuugauaaccacacuauauugcuguauuacucaacagcugccaguucccucgcagucacgcugaugaucgcgauuuucaucguguauaugaucagcagggacaaugucucuuguucaauuugccuuuga

SEQ ID NO: 148521 - RNA, 1755 nt, Artificial Sequence
  derived and/or modified sequence opt3 from hemagglutinin__InfluenzaB__ABN50734
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaagucgcuccggguucuuuaccacgauggccugggcuguaccaagagacaauaacaaaacugccacaaauccgcugaccguugaggugccccacaucuguacuaaggaagaggaucagauuacagucuggggauuccauucugacgauaaaacccagaugaagaaccuguacggugacagcaauccucaaaaguuuacguccucaaccaacggcaucacaacucacuaugugagucagauagggggauucccagaucagaccgaggacggcggucucccccagagcgggaggauuguggucgauuacaugguucaaaaaccuggaaagacaggcacuaucguguaucagcggggcauuuuacugccacagaaaguauggugcgcgucugggcgcuccaaggugaucaaaggaucacuucccuugaucggugaagcagacugucugcacgagaaguacggcgggcuaaauaaaagcaagccguauuacaccggagaacaugccaaggcuauuggcaacugcccuauaugggucaaaacaccccucaagcuggccaacgguaccaaauaccgaccuccagcaaagcugcugaaagagagaggguuuuucggcgcuaucgccggauuuuuggagggcgggugggaaggaaugauugcggguuggcacggcuauacaagucauggggcccacggaguggcaguugcugccgaucucaagucuacgcaggaggcuaucaauaagauaacuaaaaaccuuaauuccuuaagcgaacuggaggugaagaaccuccaaaggcuuucgggcgccauggacgaacugcacaaugagauuuuggagcuagacgaaaaagucgaugaccugcgggcagauaccaucucuucccagaucgagcucgccgugcugcuuucaaacgaagguauuaucaauagugaggacgaacaucuguuggcucucgagcguaagcugaaaaagauguuagggcccagcgcgguagauauuggcaacggauguuucgagacuaagcacaaaugcaaucagaccugccuggaccgcauagcagccggcacauuuaacgcuggggaguucucccuaccaaccuuugauucucucaauaucacugccgcaagccugaacgacgauggacuugacaaucauacaauuuugcuguacuauucaacggccgcuaguucccucgccguuacccugaugaucgcaaucuucauuguguacaugauaagcagagauaacgucucuuguucaaucugccuuuga

SEQ ID NO: 148522 - RNA, 1758 nt, Artificial Sequence
  derived and/or modified sequence opt3 from hemagglutinin__InfluenzaB__ABN50745
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauauuaccaacgggaauggauucuuugccacaauggcuugggcaguuccgaaaaacgacaauaacaagaccgccacgaauagucucacuaucgaggugccauacauauguacagaaggugaggaucagauuaccgucuggggcuuccacuccgacaacgagacucagauggcuaagcuguauggggauucuaaaccccagaaguuuacaagcuccgccaacggagugaccacgcacuacgugucacaaaucggcgguuucccuaaucagaccgaagacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcucacugccucuuauaggggaggcagacuguuugcaugaaaaguauggaggccugaacaagagcaaaccauacuacacaggugagcacgccaaggcuaucgggaauugccccauuugggucaaaacuccgcuaaagcucgccaacggcaccaaauauaggccucccgcaaagcugcuuaaggagcggggauuuuucggcgcuaucgccggguuucuggaaggagguugggagggcaugauagcgggguggcauggauacacaagucacggcgcccacgguguggcaguugcugccgauuugaaaucuacccaggaagcuauuaauaagaucacuaaaaaccucaauucccugagcgaguuagaagugaagaaccugcagcgccucucgggggccauggacgagcuucauaaugagauccuggaauuggaugagaaagucgacgaccuacgagcagauacgauuucuucccaaaucgaacuggccgugcuccugucaaacgagggcauuauaaauagugaagacgagcaccuucuggcuuuggagagaaagcucaagaaaaugcugggaccaagcgcgguagaaaucggcaacggguguuucgagacaaagcauaaaugcaaucagaccugcuuagauaggauugcagccggaacuuuuaacgcuggugaguucucccugccuaccuuugacucucuaaauaucacagccgcaagccucaacgaugacggccuggauaaccacaccauccuuuuguauuacucaacugccgcuaguucccuggccguuacacucaugauugcaauauucguggucuauauggugagccgggacaaugucucuuguucaaucugccuguga

SEQ ID NO: 148523 - RNA, 1752 nt, Artificial Sequence
  derived and/or modified sequence opt3 from hemagglutinin__InfluenzaB__ABN51184
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagaauauuagguugucgacacacaacgugaucaaugcagaacgggccccagggggacccuaucgccucggcacuucaggcagcugcccuaacguaaccaguaaauccggguucuuugcuacaauggcaugggccguuccaagagacaauaagaccgcuacgaacccgcugacuguggagguccccuacauuuguacaaaaggagaagaucagaucaccgugugggguuuccauucugacaauaagauacagaugaaaaaccuguauggcgauagcaauccucagaaguuuacuuccucagccaacggggugacaacccacuacgucagucaaauuggaggcuucccaaaccagacggaggacggugggcucccccagagcggaaggaucguuguggauuauaugguacagaagccuggcaaaaccggcacaauuguguaccaacgcggggucuuacugccacagaagguguggugcgcgucuggacgguccaaaguuaucaaggguucacuucccuugaucggcgaggcagacugucugcacgaaaaauaugggggacuaaauaagagcaaaccguacuacacuggcgagcaugccaaggcuauugguaacugcccuauaugggugaagacuccccucaaacuggccaaugggacaaaguaucgaccuccagcaaaacuucugaaggaaagaggcuuuuucggagcuaucgccggcuuuuuggaagggggaugggaggguaugauugcgggcuggcacggguacaccagucauggagcccacggcgucgcaguggcugccgaucucaaaucuacccaggaggcuaucaacaagauaacaaagaaucugaacuccuuaagcgagcuggaaguuaaaaaucuccagaggcuuucgggugccauggacgagcugcacaacgaaauuuuggagcuagaugagaagguagacgaccugcgggcagauaccaucucuucccaaaucgaacucgccgugcugcuuucaaaugaggggauuaucaacagugaagacgagcaucuguuggcucucgaacguaaacugaagaaaauguuaggccccagcgcggucgauauuggaaauggcuguuucgagacuaagcacaagugcaaccagacgugccuggaccgcauagcagccgggacauuuaaugcuggagaguucucccuaccaaccuuugauucucucaacaucacugccgcaagccugaaugacgauggucuugacaaccauaccauuuugcuguauuacucaacagccgcuaguucccucgccgugacccugaugaucgcaaucuucauugucuauauggugagcagagauaacguuucuuguucaauaugccuuuga

SEQ ID NO: 148524 - RNA, 1752 nt, Artificial Sequence
  derived and/or modified sequence opt3 from hemagglutinin__InfluenzaB__ABN51195
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagaauauuagguugucgacacacaacgugaucaaugcagaacgggccccagggggacccuaucgccucggcacuucaggcagcugcccuaacguaaccaguagauccggguucuuugcuacaauggcaugggccguuccaagggacaauaaaaccgcuacgaacccgcugacuguggagguccccuacauuuguacaaagggagaagaucagaucaccgugugggguuuccauuuugacaauaaaauacagaugaagaaccuguauggcgauucuaauccucagaaauucacuagcuccgccaacggggugacaacccacuacgucucacaaauuggaggcuuuccaaaccagacggaggacggugggcucccccagaguggacggaucguuguggauuauaugguacagaagccuggcaagaccggcacaauuguguaccaacgcggggucuuacugccacagaaaguguggugcgcgagcggacgaucuaagguuaucaaagguucccuucccuugaucggcgaggcagacugucugcacgaaaaguaugggggacuaaauaaaucaaagccguacuacacuggcgagcaugccaaagcuauugguaacugcccuauaugggugaagaccccacucaagcuggccaaugggacaaaauauagacccccugcaaaacuucugaaggaaaggggcuucuuuggagcuaucgccggcuucuuggaagggggaugggaggguaugauugcgggcuggcacggguacacuagccauggagcccacggcgucgcaguggcugccgaucucaagaguacccaggaggcuaucaacaaaauaacaaagaaucugaacucuuuauccgagcuggaaguaaagaaucuccagcggcuuagcggugccauggacgagcugcacaacgaaauuuuggagcuagaugagaaaguugacgaccugcgugcagauaccaucucgucucaaaucgaacucgccgugcugcuuuccaaugaggggauuaucaacucagaagacgagcaucuguuggcucucgaacgcaagcugaaaaagauguuaggccccagugcggucgauauuggaaauggcuguuuugagacuaaacacaagugcaaccagacgugccuggacagaauagcagccgggacauucaaugcuggagaguuuagccuaccaaccuucgauucccucaacaucacugccgcaucucugaaugacgauggucuugacaaccauaccauuuugcuguauuacagcacagccgcuucaagucucgccgugacccugaugaucgcaaucuucauugucuauaugguguccagggauaacguuagcuguucuauaugccuuuga

SEQ ID NO: 148525 - RNA, 1758 nt, Artificial Sequence
  derived and/or modified sequence opt3 from hemagglutinin__InfluenzaB__ABN58661
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaacuaucccuagcgcuaaaguguccauucuccacgaagucaagccagugaccucuggcuguuuucccaucaugcaugaucgcacaaaaauacgacaacugccuaaucuucugcgugguuacgagcacaucagauugucgacucauaacguaauuaaugccgaaaaggcaccagggggacccuauaaaaucggcaccucaggcagcugcccuaacguuacaaaugggaacggauucuuugccaccauggcuugggcagugccaaagaaugacaacaauaagacggccacuaacagucucacagucgaggugccguacauuuguaccgaaggugaggaucagaucacuguguggggcuuccacuccgacaaugagacacagauggcuaaacuguauggggauucuaagccccagaaauuuaccagcuccgccaacggagucacgacccacuacguuucacaaauaggcgguuucccuaaccaggcggaagacgggggacugccacagaguggcaggauugugguagauuauauggugcaaaagagcggcaaaacagggacuaucaccuaccagcgggguauucucuuaccccagaaggucuggugcgcaucuggacgcuccaaagugaucaagggcucacugccucuuaucggggaggccgacuguuugcaugaaaaguauggaggccugaauaaaagcaagccauacuacacaggugagcacgcuaaagccauugggaacugccccauauggguuaagacuccgcuaaaacucgcaaauggcaccaaguauagaccucccgcuaagcugcuuaaagagaggggauuuuucggcgccaucgcgggguuucuggaaggagguugggagggcaugauugccggguggcauggauacacaagucacggcgcacacgguguggcugucgccgcugauuugaagucuacccaggaagccaucaacaaaauaacuaagaaucucaacucccugagcgaguuagaagugaaaaaucugcagcggcucucgggggcaauggacgagcuucauaacgagauucuggaauuggaugagaagguagacgaccuacgcgccgauacgaucucuucccaaaucgaacuggcuguucuccugucaaaugagggcauuaucaacagugaagacgagcaccuucuggcguuggagcgaaagcucaaaaagaugcugggaccaagcgcaguggaaauuggcaauggguguuucgagacaaaacauaagugcaaccagaccugcuuagauagaauagccgcuggaacuuuuaaugccggugaguucucccugccuaccuuugacucucuaaacaucacagcagccagccucaaugaugacggccuggauaaccacaccauucuuuuguauuacucaacugcugccaguucccuggcagucacacucaugaucgcgaucuucauuguguauauggucagcagggacaacgugucuuguucaauaugccuguga

SEQ ID NO: 148526 - RNA, 1755 nt, Artificial Sequence; identical to SEQ ID NO: 148414
  derived and/or modified sequence opt3 from hemagglutinin__InfluenzaB__ABN59445

SEQ ID NO: 148527 - RNA, 1755 nt, Artificial Sequence
  derived and/or modified sequence opt3 from hemagglutinin__InfluenzaB__ABO72377
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcguuggaaucacuccuagcgccaaggcauccauucuacacgaagugcgcccagucaccucuggcuguuuccccaucaugcaugaucgaacaaagauacgucaacucccuaaucugcuuagagguuacgagaaaaucaggcugucgacucagaacgugauugacgccgaaaaggcuccagggggacccuaucgguugggcaccucaggcagcugcccuaaugcaacaaguaaauccggguuuuucgccaccauggcuugggccguaccacgcgauaacaauaagacggcgacuaacccgcucacaguugaggugccccacaucuguaccaaagaagaggaccagauuacugucuggggauuucauucugauaauaagacacagaugaagaaccuguacggugacagcaauccucaaaaauucaccuccucagcaaacggcaucacgacccacuaugugagucagauagggggauuuccagaucagacagaggacggcggucugccccagagcgggagaauuguggucgauuacaugguucaaaagccuggaaaaacuggcaccaucguguaucagaggggcauucucuuaccacagaagguauggugcgccucugggcgguccaaagugaucaagggaucacugccccuuaucggugaagcugacuguuugcacgagaaauacggcgggcugaauaagagcaagccguauuacacaggagaacaugccaaagcaauuggcaacugcccuauaugggucaagacuccccuaaaacucgcuaacgguaccaaguaccgcccuccagccaaacugcuuaaggagcgaggguucuuuggcgcgaucgccggauuccuggagggcgggugggaaggaaugauugcagguuggcacggcuauacaagucauggggcucacggaguggccguugcugccgauuugaagucuacccaggaggcaaucaauaaaauaacuaagaaccucaauucccugagcgaauuagaggugaaaaaccugcaaagacucucgggcgccauggacgaacuucacaaugagauucuggaguuggacgaaaaggucgaugaccuaagggcugauacgaucucuucccagaucgagcuggcggugcuccugucaaacgaagguauuaucaauagugaggacgaacaucuucuggcauuggagcggaaacucaagaagaugcuggggcccagcgccguagauauuggcaacggauguuuugagacaaaacacaagugcaaucagaccugcuuagaccguauagcugccggcacuuucaacgcaggggaauuuucccugccaaccuucgauucucuaaauaucacagccgcuagccucaacgacgauggacuggacaaucauaccauucuuuuguacuauucaacugccgcaaguucccuggcgguuacacucaugaucgcuaucuucauuguguacaugauaagccgcgauaacgucucuuguucaaucugccuguga

SEQ ID NO: 148528 - RNA, 1755 nt, Artificial Sequence; identical to SEQ ID NO: 148421
  derived and/or modified sequence opt3 from hemagglutinin__InfluenzaB__ABR15973

SEQ ID NO: 148529 - RNA, 1752 nt, Artificial Sequence
  derived and/or modified sequence opt3 from hemagglutinin__InfluenzaB__ABR15995
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaauuacgccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacuauaaaacucagaugaagaaccuguacggcgauagcaauccucagaaauuuacauccucagccaacgggauaaccacgcacuaugugagucaaauuggaggcuucccaaaucagaccgaggacggugggcucccccagagcggacggaucgucguugauuacauggugcagaagccuggcaagacaggcacuauuguauaucaacgcgggguguuacugccacagaaagucuggugcgcgucuggacgauccaaggugaucaaagguucacuucccuugaucggcgaggcagacugucugcaugaaaaguacgggggacuaaacaaaagcaagccguacuauaccggcgagcacgccaaagcuauugguaacugcccuauauggguuaagacaccccucaagcuggccaaugggacuaaauacagaccuccagcaaaacuucugaaggaaaggggcuuuuucggagcuaucgccggcuuuuuggaagggggaugggaggguaugauugcgggcuggcauggguauaccagucacggagcccacggcguggcagucgcugccgaucucaagucuacacaggaggcuaucaacaaaauaaccaagaaucugaacuccuuaagcgagcuggaagugaagaaucuccagcggcuuucgggugccauggacgagcugcauaacgaaauuuuggagcuagaugagaaaguagacgaccugcgugcagauacuaucucuucccaaaucgaacucgccguucugcuuucaaaugaggggauuaucaacagugaagacgagcaccuguuggcucucgaacgcaagcugaaaaagauguuaggccccagcgcgguggauauuggaaauggcuguuucgagacgaaacauaagugcaaccagacaugccuggacagaauagcagccgggaccuuuaaugcuggagaguucucccuaccaacuuuugauucucucaacaucaccgccgcaagccugaaugacgauggucuugacaaccacacaauuuugcuguacuauucaaccgccgcuaguucccucgccgucacucugaugaucgcaaucuucauuguguacauggucagcagggauaaugugucuuguucaauaugccuuuga

SEQ ID NO: 148530 - RNA, 1758 nt, Artificial Sequence
  derived and/or modified sequence opt3 from hemagglutinin__InfluenzaB__ABR16017
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 148531 - RNA, 1758 nt, Artificial Sequence; identical to SEQ ID NO: 148530
  derived and/or modified sequence opt3 from hemagglutinin__InfluenzaB__ACA64899

SEQ ID NO: 148532 - RNA, 1758 nt, Artificial Sequence
  derived and/or modified sequence opt3 from hemagglutinin__InfluenzaB__ACA64932
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacauuaacaaaaccgcaacuaauucccucacgaucgaagucccguacauauguacagagggugaggaucagauuaccguguggggcuuccacucugacaacgaaacucagauggccaagcuguauggggauagcaaaccccagaaguuuacauccucagcuaacggagugaccacgcacuacgucagucaaaucggcgguuucccuaaucagaccgaggacgggggacugccacagagcggccgcauuguuguggauuauaugguacagaagucuggcaaaacagggacuaucaccuaccaaagaggaauccucuuaccccagaagguguggugcgccuccgguaggucaaaagucauuaagggcagccugccucuuauaggggaagcggacuguuugcaugagaaauauggaggccugaacaagaguaaaccauacuacacaggugagcacgcaaaggccaucgggaauugccccauuugggugaagacuccgcuaaaacucgcuaacggcaccaaguaucggccucccgccaaacugcuuaaggaacgcggauuuuucggcgcaaucgcuggguuucuggagggagguugggaaggcaugauagccggguggcauggauacacaucucacggcgcgcacgguguugccguggcagcugauuugaaauccacccaggaggccauuaauaagaucacuaagaaccucaauagccugucggaauuagaggucaaaaaccugcagcgacucucuggggcuauggacgagcuucauaaugaaauccuggaguuggaugaaaagguggacgaccuaagagccgauacgauuuccucacaaaucgagcuggcaguacuccugaguaacgaaggcauuauaaauagcgaggacgagcaccuucuggccuuggaaaggaaacucaagaaaaugcugggaccauccgcuguugagaucggcaacggguguuucgaaacaaagcauaagugcaaucagaccugcuuagauaaaauugcggcaggaacuuuugacgccggugaguucucucugccuaccuuugauagccuaaacaucacagcugccucacucaaugacgauggccuggacaaccacaccauccuuuuguauuacaguacugcagccuccagccuggcugugacacucaugauugccauauucgucguguauauggucucucgggauaacgugucauguaguaucugccuguga

SEQ ID NO: 148533 - RNA, 1758 nt, Artificial Sequence; identical to SEQ ID NO: 148530
  derived and/or modified sequence opt3 from hemagglutinin__InfluenzaB__ACA64943

SEQ ID NO: 148534 - RNA, 1758 nt, Artificial Sequence
  derived and/or modified sequence opt3 from hemagglutinin__InfluenzaB__ACA64954
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaguucccucacuauugaagucccguacaucuguacagagggugaggaucagauaaccguguggggcuuccacucugacaacgaaacucagauggcuaagcuguauggggauagcaaaccccagaaguuuacauccucagccaacggagugaccacgcacuacgucagucaaauuggcgguuucccuaaucagaccgaggacgggggacugccacagagcggccgcaucguuguggauuauaugguacagaagucuggcaaaacagggacuauuaccuaccaaagaggaauccucuuaccccagaagguguggugcgcguccgguaggucaaaagucaucaagggcagccugccucuuauuggggaagcagacuguuugcaugagaaauauggaggccugaacaagaguaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaucucacggcgcccacgguguugcaguggcugccgauuugaaauccacccaggaggcuauaaauaagauuacuaagaaccucaauagccugucggaauuagaggucaaaaaccugcagcgacucucuggggccauggacgagcuucauaaugaaauccuggaguuggaugaaaagguggacgaccuaagagcagauacgaucuccucacaaauugagcuggccguacuccugaguaacgaaggcaucauuaauagcgaggacgagcaccuucuggcuuuggaaaggaaacucaagaaaaugcugggaccauccgcgguugagauaggcaacggguguuucgaaacaaagcauaagugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccgugacacucaugaucgcaauuuucgucguguauauggucucucgugauaacgugucauguaguauaugccuguga

SEQ ID NO: 148535 - RNA, 1758 nt, Artificial Sequence; identical to SEQ ID NO: 148530
  derived and/or modified sequence opt3 from hemagglutinin__InfluenzaB__ACA64965

SEQ ID NO: 148536 - RNA, 1758 nt, Artificial Sequence
  derived and/or modified sequence opt3 from hemagglutinin__InfluenzaB__ACA64998
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuuaacuguaccgauuuagacguugcgcuggggcggcccaagugcacgggaaauaucccuagcgcucgcguguccauucuacacgagguccgaccagugacuucuggcuguuuccccaucaugcaugaucguaccaagauaagacaacucccuaaccugcuuagggguuacgaacacauccggcugucgacacauaauguaauuaacgccgagaaugcaccagggggacccuauaaaaucggcacuucaggcagcugcccuaacguuaccaaugggaacggauuuuucgccacaauggcuugggcagugccaaagaaugacaacaauaaaaccgccacgaacaguuugacuauugaagucccguacaucuguacagagggugaggaucagauaaccguguggggcuuucacuccgacaacgaaacucagauggcuaagcucuauggggauucuaaaccccagaaguucacaagcuccgccaauggagugaccacgcacuacgucucacaaauuggcgguuuuccuaaccagaccgaggacgggggacugccacagaguggccgcaucguuguggauuauaugguacaaaagagcggcaaaacagggacuauuaccuaccagagaggaauccugcucccccagaagguguggugcgcgucugguagguccaaagucaucaagggcucauuaccucugauuggggaagcagacugucuucaugagaaauauggaggcuugaauaagagcaaaccauacuacacaggugagcacgccaaggcuauagggaacugccccaucugggugaagacuccgcugaaacuagccaauggcaccaaguaucggccucccgcaaaacuccugaaggaacgcggauucuuuggcgcuauugccggguuccuugagggagguugggaaggcaugaucgcgggguggcauggauacacaagucacggcgcccacgguguugcaguggcugccgaucugaaaucuacccaggaggcuauaaacaagauuacuaagaauuugaacucccucagcgaacuggaggucaaaaauuuacagcgacugucgggggccauggacgagcuccauaacgaaauccuugagcuggaugaaaagguggacgacuugagagcagauacgaucucuucccaaauugagcuagccguacugcucucaaaugaaggcaucauuaacagugaggacgagcaucugcuugcucuggaaaggaaauugaagaaaaugcucggaccaagcgcgguugagauaggcaauggguguuuugaaacaaagcacaagugcaaccagaccugccuggaucggaucgcagccggaacuuucgacgcuggugaguuuuccuuaccuaccuucgauucucugaauauuacagccgcaagccuaaacgacgauggccucgacaaccacaccauccugcuuuauuacucaacugccgcuaguuccuuggccgugacacugaugaucgcaauuuucgucguguauauggucagccgugauaaugugucuuguucaauaugccucuga

SEQ ID NO: 148537 - RNA, 1758 nt, Artificial Sequence
  derived and/or modified sequence opt3 from hemagglutinin__InfluenzaB__ACA65020
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacaacaauaaaaccgcaacgaacucccucacuauugaagucccguacaucuguacagagggugaggaucagauaaccauuuggggcuuccacucugacaacgaaacucagauggccaagcuguauggggauagcaaaccccagaaguuuacauccucagcuaauggagugaccacgcacuacgugagucaaaucggcgguuucccuaaccagaccgaggacgggggacugccacagagcggccgcauugucguugauuauauggugcagaagucuggcaaaacagggacuaucaccuaccaaagaggaauccucuuaccccagaagguauggugcgccuccgguaggucaaaagugauuaagggcagccugccucuuauaggggaagcggacuguuugcaugagaaauauggaggccugaauaagaguaaaccauacuacacaggugagcacgcaaaggccaucgggaacugccccauuugggucaagacuccgcuaaaacucgcuaauggcaccaaguaucggccucccgccaaacugcuuaaggaacgcggauuuuucggcgcaaucgcuggguuucuggagggagguugggaaggcaugauagccggguggcauggauacacaucucacggcgcgcacgguguggccguugcagcugauuugaaauccacccaggaggccauuaacaagaucacuaagaaucucaacagccugucggaauuagaggugaaaaaucugcagcgacucucuggggcuauggacgagcuucauaacgaaauccuggaguuggaugaaaaggucgacgaccuaagagccgauacgauuuccucacaaaucgagcuggcagugcuccugaguaaugaaggcauuauaaacagcgaggacgagcaccuucuggccuuggaaaggaaacucaagaaaaugcugggaccauccgcuguagagguuggcaauggguguuucgaaacaaagcauaagugcaaccagaccugcuuagaucggaucgcggcaggaacuuuugacgccggugaguucucucugccuaccuuugauagccuaaauauuacagcugccucacucaacgacgauggccuggacaaccacaccauccuuuuguauuacaguacugcagccuccagccuggcugugacacucaugaucgccauuuucgucguguauauggucucucgugauaaugugucauguaguauaugccuguga

SEQ ID NO: 148538 - RNA, 1758 nt, Artificial Sequence; identical to SEQ ID NO: 148536
  derived and/or modified sequence opt3 from hemagglutinin__InfluenzaB__ACA65031

SEQ ID NO: 148539 - RNA, 1758 nt, Artificial Sequence
  derived and/or modified sequence opt3 from hemagglutinin__InfluenzaB__ACA65042
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacaacaauaaaaccgcaacgaacucccucacuauugaagucccguacaucuguacagagggugaggaucagauaaccguguggggcuuccacucugacaacgaaacucagauggccaagcuguauggggauagcaaaccccagaaguuuacauccucagcuaauggagugaccacgcacuacgucagucaaauuggcgguuucccuaaccagaccgaggacgggggacugccacagagcggccgcaucauuguugauuauauggugcagaagucuggcaaaacagggacuaucaccuaccaaagaggaauccucuuaccccagaagguauggugcgccuccgguaggucaaaagugauuaagggcagccugccucuuauaggggaagcggacuguuugcaugagaaauauggaggccugaauaagaguaaaccauacuacacaggugagcacgcaaaggccaucgggaacugccccauuugggucaagacuccgcuaaaacucgcuaauggcaccaaguaucggccucccgccaaacugcuuaaggaacgcggauuuuucggcgcaaucgcuggguuucuggagggagguugggaaggcaugauagccggguggcauggauacacaucucacggcgcgcacgguguggccguugcagcugauuugaaauccacccaggaggccauuaacaagaucacuaagaaucucaacagccugucggaauuagaggugaaaaaucugcagcgacucucuggggcuauggacgagcuucauaacgaaauccuggaguuggaugaaaaggucgacgaccuaagagccgauacgauuuccucacaaaucgagcuggcagugcuccugaguaaugaaggcauuauaaacagcgaggacgagcaccuucuggccuuggaaaggaaacucaagaaaaugcugggaccauccgcuguagagaucggcaauggguguuucgaaacaaagcauaagugcaaccagaccugcuuagaucggauugcggcaggaacuuuugacgccggugaguucucucugccuaccuuugauagccuaaauaucacagcugccucacucaacgacgauggccuggacaaccacaccauccuuuuguauuacaguacugcagccuccagccuggcuguuacacucaugauugccauauucguggucuauauggugucucgugauaaugucucauguaguaucugccuguga

SEQ ID NO: 148540 - RNA, 1758 nt, Artificial Sequence
  derived and/or modified sequence opt3 from hemagglutinin__InfluenzaB__ACA65053
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacgcaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccauuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggcagaaucguuguggauuauaugguacaaaagagcggcaaaacagggacuauuaccuaccagaggggaauccucuuaccccagaagguguggugcgcgucuggucgguccaaagucaucaagggcucacugccucuuauuggggaagcagacuguuugcacgagaaauauggaggccugaauaagagcaaaccauacuacacaggugagcaugccaaggcuauagggaacugccccaucugggugaagacuccgcuaaaacucgccaauggcaccaaguaucgcccucccgcaaaacugcuuaaggaacgaggauuuuucggcgcuauugccggguuucuggagggagguugggaaggcaugaucgcgggguggcacggauacacaagucauggcgcccacgguguugcaguggcugccgauuugaaaucuacccaggaggcuauaaacaagauuacuaagaaucucaacucccugagcgaauuagaggucaaaaaucugcagagacucucgggggccauggacgagcuucacaacgaaauccuggaguuggaugaaaagguggacgaccuaagggcagauacgaucucuucccaaauugagcuggccguacuccugucaaaugaaggcaucauuaacagugaggacgagcaucuucuggcuuuggaacggaaacucaagaaaaugcugggaccaagcgcgguugagauaggcaauggguguuucgaaacaaagcacaagugcaaccagaccugcuuagaucguaucgcagccggaacuuuugacgcuggugaguucucccugccuaccuuugauucucuaaauauuacagccgcaagccucaacgacgauggccuggacaaccauaccauccuuuuguauuacucaacugccgcuaguucccuggccgugacacucaugaucgcaauuuucgucguguauauggucagccgcgauaaugugucuuguucaauaugccuguga

SEQ ID NO: 148541 - RNA, 1758 nt, Artificial Sequence
  derived and/or modified sequence opt3 from hemagglutinin__InfluenzaB__ACA65075
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacauuaccaaugggaacggauucuuugccacaauggcuugggcaguuccaaagaaugacaacaauaaaaccgccacgaacagucucacuaucgaagugccguacauauguacagagggugaggaucagauuaccgucuggggcuuccacuccgacaacgaaacucagauggcuaagcuguauggggauucuaaaccccagaaguuuacaagcuccgccaauggagugaccacgcacuacgugucacaaaucggcgguuucccuaaccagaccgaggacgggggacugccacagaguggccgcauugucguugauuauauggugcaaaagagcggcaaaacagggacuaucaccuaccagagaggaauccucuuaccccagaagguauggugcgcgucugguagguccaaagugauuaagggcucacugccucuuauaggggaagcagacuguuugcaugagaaauauggaggccugaauaagagcaaaccauacuacacaggugagcacgccaaggcuaucgggaacugccccauuugggucaagacuccgcuaacccucgccaauggcacaaaauaucggccucccgcaaagcugcuuaaagaacgcggauuuuucggcgcuaucgccggguuucuggagggagguugggaaggcaugauagcgggguggcauggauacaccagucacggcgcccacgguguggcaguugcugccgauuugaagucuacucaggaggcuauuaacaaaaucacgaagaaucucaacucccugagcgaauuagaggugaagaaucugcagcgacucucgggggccauggacgagcuucauaacgaaauccuggaguuggaugaaaaagucgacgaccuaagagcagauacaauuucuucccaaaucgagcuggccgugcuccugucaaaugaaggcauuauaaacagugaggacgagcaccuucuggcuuuggaaaggaagcucaaaaagaugcugggaccaagcgcgguagagaucggcaauggguguuucgaaaccaaacauaagugcaaccagacuugcuuagaucggauugcagccggaaccuuugacgcuggugaguucucccugccuacauuugauucucuaaauaucaccgccgcaagccucaacgacgauggccuggacaaccacacuauccuuuuguauuacucaacagccgcuaguucccuggccguuacgcucaugauugcaauauucguggucuauauggugagccgugauaaugucucuuguucaaucugccuguga

SEQ ID NO: 148542 - RNA, 1758 nt, Artificial Sequence; identical to SEQ ID NO: 148530
  derived and/or modified sequence opt3 from hemagglutinin__InfluenzaB__ACA65086

SEQ ID NO: 148543 - RNA, 1758 nt, Artificial Sequence; identical to SEQ ID NO: 148530
  derived and/or modified sequence opt3 from hemagglutinin__InfluenzaB__ACA65097

SEQ ID NO: 148544 - RNA, 1758 nt, Artificial Sequence; identical to SEQ ID NO: 148530
  derived and/or modified sequence opt3 from hemagglutinin__InfluenzaB__ACA96552

SEQ ID NO: 148545 - RNA, 1758 nt, Artificial Sequence; identical to SEQ ID NO: 148530
  derived and/or modified sequence opt3 from hemagglutinin__InfluenzaB__ACA96563

SEQ ID NO: 148546 - RNA, 1758 nt, Artificial Sequence; identical to SEQ ID NO: 148530
  derived and/or modified sequence opt3 from hemagglutinin__InfluenzaB__ACA96574

SEQ ID NO: 148547 - RNA, 1758 nt, Artificial Sequence; identical to SEQ ID NO: 148530
  derived and/or modified sequence opt3 from hemagglutinin__InfluenzaB__ACA96585

SEQ ID NO: 148548 - RNA, 1758 nt, Artificial Sequence
  derived and/or modified sequence opt3 from hemagglutinin__InfluenzaB__ACA96596
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauagacaagauuacuaagaaccucaauucccugagcgaauuagaggucaaaaaccugcagcgacucucgggggccauggaugagcuucauaaugaaauccuggaguuggacgaaaagguggacgaucuaagagcagacacgaucucuucccaaauugagcuggccguacuccugucaaacgaaggcaucauuaauagugaggaugagcaccuucuggcuuuggaaaggaaacucaagaaaaugcugggaccaagcgcgguugagauaggcaacggguguuucgaaacaaagcauaagugcaaucagaccugcuuagaccggaucgcagccggaacuuuugaugcuggugaguucucccugccuaccuuugacucucuaaacauuacagccgcaagccucaaugaugacggccuggauaaccacaccauccuuuuguauuacucaacugccgcuaguucccuggccgugacacucaugaucgcaauuuucgucguguauauggucagccgugacaacgugucuuguucaauaugccuguga

SEQ ID NO: 148549 - RNA, 1758 nt, Artificial Sequence; identical to SEQ ID NO: 148530
  derived and/or modified sequence opt3 from hemagglutinin__InfluenzaB__ACA96607

SEQ ID NO: 148550 - RNA, 1758 nt, Artificial Sequence
  derived and/or modified sequence opt3 from hemagglutinin__InfluenzaB__ACA96618
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucuuucugccuaccuucgauucccuaaauauuacagccgcaucucucaacgacgauggccuggacaaccacaccauccuuuuguauuacagcacugccgcuucaagucuggccgugacacucaugaucgcaauuuucgucguguauauggucucccgugauaaugugagcuguucuauaugccuguga

SEQ ID NO: 148551 - RNA, 1758 nt, Artificial Sequence; identical to SEQ ID NO: 148530
  derived and/or modified sequence opt3 from hemagglutinin__InfluenzaB__ACA96629

SEQ ID NO: 148552 - RNA, 1758 nt, Artificial Sequence; identical to SEQ ID NO: 148536
  derived and/or modified sequence opt3 from hemagglutinin__InfluenzaB__ACA96640

SEQ ID NO: 148553 - RNA, 1755 nt, Artificial Sequence
  derived and/or modified sequence opt3 from hemagglutinin__InfluenzaB__ACD56566
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaguugaugcagaaaacgccccagggggacccuaccgccucggcaccucaggcagcugcccuaaugcuacaaguaaguccggguucuuugcaaccauggccugggcugugccaaaagacaacaauaagaacgccacgaauccgcugacugucgaggugcccuauguguguacagaaggagaggaucagaucaccgucugggguuuccauucugacaacaaaacucagaugaagaaucuguacggcgauagcaacccucaaaaauuuacauccucagcgaacgggguuaccacgcacuaugugagucagauuggaggcuucccagcacagaccgaggacggugggcucccccagagcggaagaaucguaguggauuacaugguccaaaagccuaggaagacaggcacuauuguguaucagcggggcguuuuacugccacagaaaguguggugcgccucugggcgcuccaaggucaucaaaggaucacuucccuugauaggugaagcugacugucugcaugagaaguacggcgggcuaaauaaaagcaagccguacuauaccggagaacacgccaaagcaauuggcaacugcccuaucugggugaagacaccccucaagcuggcuaaugguacuaaauaccgaccuccagccaaacuucugaaggagagaggguuuuucggcgcgauugccggauuuuuggagggcgggugggaaggaaugaucgcagguuggcacggcuauaccagucauggggcucacggaguagccguugcugccgaucucaagucuacacaggaggcaaucaacaaaauuaccaagaaucugaacuccuuaagcgaacuggaggugaagaaucuccaaaggcuuucgggcgccauggacgaacugcauaacgagauauuggagcuagacgaaaaagucgaugaccugcgggcugauacuaucucuucccagauugagcucgcggugcugcuuucaaaugaagguaucauaaacagugaggacgaacaccuguuggcacucgagcguaagcugaaaaagauguuagggcccagcgccgucgauauuggcaauggauguuucgagacgaaacacaagugcaaccagacaugccuggacaagaucgcugccggcaccuuuaaugcaggggaguucucccuaccaacuuuugauucucucaacaucaccgccgcuagccugaaugacgauggacuugacaaccauacaauuuugcuguacuauucaaccgccgcaaguucccucgcggugacucugaugcuugcuaucuucauuguuuacauggugagccgcgauaacguaucuuguucaauaugccuguga

SEQ ID NO: 148554 - RNA, 1755 nt, Artificial Sequence
  derived and/or modified sequence opt3 from hemagglutinin__InfluenzaB__ACD56577
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauauuuguacagaaggagaggaucagaucaccgugugggguuuccauucugacaacaaagcgcagaugaagaaucuguacggcgauagcaacccucaaaaauuuacuuccucagcaaacggggugacaacccacuaugucagucagauuggaggcuucccagcccagacggaggacggugggcucccccagagcggaagaaucguuguggauuacaugguacaaaagccuaggaagaccggcacaauaguguaucagcggggcgucuuacugccacagaaaguguggugcgcuucugggcgcuccaagguuauuaaaggaucacuucccuugaucggugaagccgacugucugcaugagaaguacggcgggcuaaauaaaagcaagccguacuauacuggagaacacgcaaaagcuauuggcaacugcccuaucugggugaagacuccccucaagcuggccaaugguacaaaauaccgaccuccagcgaaacuucugaaggagagaggguuuuucggcgccaucgcaggauuuuuggagggcgggugggaaggaaugauugcugguuggcacggcuauaccagucauggggcccacggagucgcuguggccgcagaucucaagucuacccaggaggccauaaacaaaaucacaaagaaucugaacuccuuaagcgaacuggagguaaagaaucuccaaaggcuuucgggcgcuauggacgaacugcauaacgagauuuuggagcuagacgaaaaaguugaugaccugcgggcggauaccaucucuucccagauagagcucgcagugcugcuuucaaaugaagguauuaucaacagugaggacgaacaccuguuggcccucgagcguaagcugaaaaagauguuagggcccagcgcugucgauaucggcaauggauguuucgagacuaaacacaagugcaaccagacgugccuggaccgcauugccgcaggcacauuuaaugccggggaguucucccuaccaaccuuugauucucucaacaucacugcugccagccugaaugacgauggacuugacaaccauaccauuuugcuguacuauucaacagcagcgaguucccucgcugugacccugaugcuugccauauucaucgucuacauggugagcagagauaacguuucuuguucaauuugccuguga

SEQ ID NO: 148555 - RNA, 1758 nt, Artificial Sequence; identical to SEQ ID NO: 148536
  derived and/or modified sequence opt3 from hemagglutinin__InfluenzaB__ACF41658

SEQ ID NO: 148556 - RNA, 1758 nt, Artificial Sequence
  derived and/or modified sequence opt3 from hemagglutinin__InfluenzaB__ACF54136
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacaagacucagauggcuaaacuguauggggauucuaagccccagaaguuuacaagcuccgccaauggagugaccacgcacuacgucucacaaauuggcgguuucccuaaccagaccgaagacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaggcagacuguuugcaugaaaaguauggaggccugaauaaaagcaagccauacuacacaggugagcacgccaaggcuauagggaacugccccaucugggugaaaacuccgcuaaagcucgccaauggcaccaaauaucggccucccgcaaagcugcuuaaagagcgcggauuuuucggcgcuauugccggguuucuggaaggagguugggagggcaugaucgcgggguggcauggauacacaagucacggcgcccacgguguugcaguggcugccgauuugaagucuacccaggaagcuauaaacaagauuacuaaaaaucucaacucccugagcgaguuagaagucaagaaucugcagcgacucucgggggccauggacgagcuucauaacgagauccuggaauuggaugagaaaguggacgaccuaagagcagauacgaucucuucccaaauugaacuggccguacuccugucaaaugagggcaucauuaacagugaagacgagcaccuucuggcuuuggagaggaagcucaaaaagaugcugggaccaagcgcgguugaaauaggcaauggguguuucgagacaaagcauaaaugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaauauaucuuguucaaucugccuguga

SEQ ID NO: 148557 - RNA, 1758 nt, Artificial Sequence; identical to SEQ ID NO: 148530
  derived and/or modified sequence opt3 from hemagglutinin__InfluenzaB__ACF54147

SEQ ID NO: 148558 - RNA, 1755 nt, Artificial Sequence
  derived and/or modified sequence opt3 from hemagglutinin__InfluenzaB__ACF54158
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagaggggaguguuacugccucagaaggucuggugcgccucugggcgguccaaagugauuaaggguucacuuccauugaucggcgaagcugauugucugcaugagaaauacgggggacuaaacaagagccgccccuacuauaccggcgaacacgccaaagcaauugguaauugcccgaucuggguuaagacaccucucaagcuggcuaacgggacuaaauaccgacccccagccaagcugcugaaagagagaggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaaaaucaccaagaaccuuaauuccuuaagcgaacuggaggugaagaaccuccaaaggcuuucgggugccauggacgaacugcauaaugagauuuuggagcuagaugaaaaaguagacgaucugcgggcugacacuaucucuucccagauagagcucgcgguucugcuuucaaacgaagggauuaucaauagugaggaugaacaccuguuggcacucgagcguaagcugaaaaagauguuaggcccuagcgccguggacaucggaaacggcuguuucgagacgaaacacaagugcaaucagacaugccuggaucgcauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagcagagacaacgugucuuguucaauuugccuguga

SEQ ID NO: 148559 - RNA, 1755 nt, Artificial Sequence
  derived and/or modified sequence opt3 from hemagglutinin__InfluenzaB__ACF54169
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacuccuaugaagaaucuguacggcgauagcaacccacagaaauuuacauccucagcgaacggggucaccacgcacuauguuagucaaaucggaggcuuccccgcacagaccgaggacgaagguauuccucagagcgggagaaucgugguagauuacauggugcagaagccaaggaagacaggaacuauagucuaucaacggggcgugcucuuaccccagaaaguuuggugcgccucuggccgcuccaaggugauuaaagggucacugccgcuuaucggagaggcugacuguuugcaugaaaaguacgguggccugaauaaaagcaagccuuacuauaccggggagcacgccaaagcaauuggaaacugccccaucugggucaagacaccacuaaagcucgcuaauggcacuaaauaccgaccucccgccaagcugcuuaaagagagaggguuuuucggugcgaucgccggcuuucuggaaggaggcugggaggggaugauugcaggauggcacgguuauaccagucauggcgcucacgggguggccguagcugccgauuugaagucuacacaggaagcaauauccaaaaucaccaagaaccucaauagccugucggaguuagaaguuaagaaccugcagaggcucucuggagccauggacgagcuucauaaugagauucuggaauuggacgagaaaguggaugaccuacgggcugauacuaucuccucacaaauagaacuggcgguccuccugaguaacgagggcauuaucaauagcgaagacgagcaccuucuggcauuggagcguaagcucaaaaagaugcuggguccauccgccguggauaucgggaacggcuguuucgaaacgaaacacaagugcaaucagacaugcuuagaccgcauugcugccggaaccuuuaacgcaggcgaguucucucugcccacuuuugauagccuaaauaucaccgccgcuucacucaacgacgaugggcuggacaaucauacaauucuuuuguacuauaguaccgccgcauccagccuggcggucacucucaugcuggcuauauucaucguguacaugguuucuagagauaacgugucauguaguauuugccuuuga

SEQ ID NO: 148560 - RNA, 1755 nt, Artificial Sequence
  derived and/or modified sequence opt3 from hemagglutinin__InfluenzaB__ACF54180
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacuccuaugaagaaucuguacggcgauagcaacccacagaaauuuacauccucagcgaacggggucaccacgcacuauguuagucaaaucggaggcuuccccgcacagaccgaggacggugggcucccucagagcggaagaauugugguagauuacauggugcagaagccaaggaagacaggcacuaucgucuaucaacggggcguguuacugccccagaaaguuuggugcgccucugggcgcuccaaggugauaaaaggaucacuuccguugauuggugaagcugacugucugcaugagaaguacggcgggcuaaauaaaagcaagccuuacuauaccggagaacacgccaaagcaaucggcaacugccccauuugggucaagacaccacucaagcuggcuaaugguacuaaauaccgaccucccgccaaacuucugaaggagagaggguuuuucggcgcgaucgccggauuuuuggagggcgggugggaaggaaugaucgcagguuggcacggcuauaccagucauggggcucacggaguggccguagcugccgaucucaagucuacacaggaggcaauuaacaaaauaaccaagaaucugaacuccuuaagcgaacuggagguuaagaaucuccagaggcuuucgggcgccauggacgaacugcauaacgagaucuuggagcuagacgaaaaaguggaugaccugcgggcugauacuauuucuucccaaaucgagcucgcgguccugcuuucaaaugaagguauaauuaacagugaggacgaacaccuguuggcacucgagcguaagcugaaaaagauguuagggccaagcgccguggauaucggcaauggauguuucgagacgaaacacaagugcaaccagacaugccuggaccgcaucgcugccggcaccuuuaaugcaggggaguucucccuacccacuuuugauucucucaacauuaccgccgcuagccugaaugacgauggacuugacaaccauacaaucuugcuguacuauucaaccgccgcaaguucccucgcggucacucugaugcuugcuauuuucauaguguacaugguuagcagagauaacgugucuuguucaaucugccuguga

SEQ ID NO: 148561 - RNA, 1755 nt, Artificial Sequence
  derived and/or modified sequence opt3 from hemagglutinin__InfluenzaB__ACF54202
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaagaagcugcccuaaugcuacaaguaaguccggcuucuuugcaaccauggccugggcuguuccaaaagacaacaauaagaacgccacgaauccgcugacuguggagguccccuauguguguacagaaggggaggaucagauuaccguguggggauuccauucugacaacaaaacucagaugaagaaucuguacggugauagcaacccucaaaaauuuacauccucagcgaacggcgucaccacgcacuauguuagucagaucgggggauucccagcacagaccgaggacgaaggccucccccagagcgguaggauugugguagauuacauggugcaaaagccucggaagacagggacuaucgucuaucagcgcggaguguuacugccacagaaaguuuggugcgccucuggccgauccaaggugauaaaaggcucacuucccuugauuggggaggcugacugucugcaugaaaaguacggaggucuaaauaaaagcaagccguacuauaccggcgagcacgccaaagcaaucgggaacugcccuauuugggucaagacaccccucaagcuggcuaauggaacuaaauacagaccuccagccaaacuucugaaggagaggggcuuuuucggugcgaucgccggguuuuuggaaggcggaugggagggcaugaucgcaggguggcacggauauaccagucauggugcucacggcguggccguagcugccgaucucaagucuacacaggaagcaauuaacaaaauaaccaagaaucugaacuccuuaagcgagcuggaaguuaagaaucuccaacggcuuucgggggccauggacgagcugcauaacgagaucuuggaacuagacgagaaaguggaugaccugcgugcugauacuauuucuucccagaucgaacucgcgguccugcuuucaaaugagggaauaauuaacagugaagacgagcaccuguuggcacucgagcgcaagcugaaaaagauguuaggccccagcgccguggauaucgguaauggguguuucgaaacgaaacacaagugcaaccagacaugccuggacagaaucgcugccggcaccuuuaaugcaggagaguucucccuaccaacuuuugauucucucaacauuaccgccgcuagccugaaugacgauggccuugacaaccauacaaucuugcuguacuauucaaccgccgcaaguucccucgcggucacucugaugcuugcuauuuucauaguguacaugguuagcagggauaacgugucuuguucaaucugccuguga

SEQ ID NO: 148562 - RNA, 1755 nt, Artificial Sequence
  derived and/or modified sequence opt3 from hemagglutinin__InfluenzaB__ACF54213
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacgauaagacucagaugaaaaaucuguacggcgacagcaacccucaaaaguuuacauccucagcgaauggggugaccacgcacuaugucagucagauuggaggcuucccagaucagaccgaggacggugggcucccccagagcggaagaaucguuguggauuacaugaugcaaaagccuggcaaaacaggcacuauaguauaucagaggggaguguuacugccacagaaggucuggugcgcaucugggcgguccaaagugauuaaggguucacuucccuugaucggcgaagccgacugucugcaugagaaauacgggggacuaaacaagagcaaaccguacuauaccggcgaacacgcuaaggccauugguaacugcccuaucuggguuaagacaccccucaaacuggcaaaugggacuaaguaccgcccuccagcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacacaggaggccauaaacaagaucaccaagaaucugaacuccuuaagcgaacuggaggugaaaaaucuccaaagacuuucgggugcaauggaugaacugcauaacgagauuuuggagcuagacgaaaagguagaugaccugagggccgauacuaucucuucccagauagagcucgcuguucugcuuucaaaugaagggauuaucaacagugagaaugaacaccuguuggcgcucgagcggaaacugaagaaaauguuaggccccagcgcaguggacaucggaaacggcuguuucgagacgaagcacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcagucacucugaugcuugcgauauucaucguguacauggucagccgcgacaacgugucuuguucaauuugccuguga

SEQ ID NO: 148563 - RNA, 1758 nt, Artificial Sequence
  derived and/or modified sequence opt3 from hemagglutinin__InfluenzaB__ACF54224
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccucaaacggagugaccacgcacuacgucagucaaauuggcgguuucccuaaucagaccgaggacgggggacugccacagagcggccggaucguuguggauuauaugguacagaagucuggcaaaacagggacuauuaccuaccaacgcggaauccucuuaccccagaagguguggugcgccuccgguagaucaaaagucaucaagggcagccugccucuuauuggggaagcggacuguuugcaugagagguauggaggccugaacaaaaguaagccauacuacacaggugagcacgcaaaggccauagggaauugccccaucugggugaaaacuccgcuaaagcucgcuaacggcaccaaauaucggccucccgccaagcugcuuaaagaacgcggauuuuucggcgcaauugcuggguuucuggagggagguugggaaggcaugaucgccggguggcauggauacacaucucacggcgcgcacgguguugccguggcagcugauuugaaguccacccaggaggccauaaauaagauuacuaaaaaccucaauagccugucggaauuagaggucaagaaccugcagcgacucucuggggcuauggacgagcuucauaaugaaauccuggaguuggaugaaaaaguggacgaccuaagagccgauacgaucuccucacaaauugagcuggcaguacuccugaguaacgaaggcaucauuaauagcgaggacgagcaccuucuggccuuggaaaggaagcucaaaaagaugcugggaccauccgcuguugagauaggcaacggguguuucgaaacaaagcauaaaugcaaucagaccugcuuagaucggaucgcggcaggaacuuuugacgccggugaguucucucugccuaccuuugauagccuaaacauuacagcugccucacucaaugacgauggccuggacaaccacaccauccuuuuguauuacaguacugcagccuccagccuggcugugacacucaugaucgccauuuucgucguguauauggucucucgugauaacgugucauguaguauaugccuguga

SEQ ID NO: 148564 - RNA, 1755 nt, Artificial Sequence
  derived and/or modified sequence opt3 from hemagglutinin__InfluenzaB__ACF54257
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauugacgccgaaaaggcuccagggggacccuaucggcucggcaccucaggcagcugcccuaaugcaacaaguaaauccggguucuuugccaccauggcuugggccguaccacgcgagaacaauaagacggcgacuaacccgcugacaguugaagugccccacaucuguaccaaagaggaggaucagauuacugucuggggauuccauucugacaauaagccucagaugaagaaccuguacggugauagcaauccacaaaaauuuacauccucagcaaacggcaucaccacgcacuaugugagucagauagggggauuccccgaccagaccgaagauggcggucucccucagagcgggagaauuguggucgacuacaugguucaaaagccaggaaaaacaggcacuaucguguaucagaggggcauuuuacugccccagaagguauggugcgccucugggcgguccaaagugaucaagggaucacuuccguugaucggugaggcugauugucugcacgaaaaauacggcgggcuaaauaagagcaagccuuauuacaccggagagcaugccaaagcaauuggcaacugccccauaugggucaagacaccacucaaacuggcuaacgguacuaaguaccgcccucccgccaaacuucugaaggagcgaggguuuuucggcgcgaucgccggauuuuuggaaggcgggugggagggaaugauugcagguuggcacggcuauaccagucauggggcucacggaguggccguugcugccgaccucaagucuacacaggaagcaaucaauaaaauaaccaagaacuuaaauucccugagcgagcuggaagugaaaaaccuccaaagacuuucgggcgccauggaugagcugcacaaugagauuuuggaacuagacgagaaggucgacgaucugagggcugacacuaucucuucccagaucgaacucgcggugcugcuuucaaacgaggguauuaucaauagugaagaugagcaucuguuggcacucgagcggaaacugaagaagauguuagggccaagcgccguagacauuggcaacggauguuucgaaacgaaacacaagugcaaucagacaugccuggaucguauagcugccggcaccuuuaacgcaggggaguucucccuacccacuuuugacucucucaauaucaccgccgcuagccugaacgaugacggacuugauaaucauacaauuuugcuguacuauucaaccgccgcaaguucccucgcgguuacucugaugaucgcuaucuucauuguguacaugauaagccgcgacaacgucucuuguucaaucugccuuuga

SEQ ID NO: 148565 - RNA, 1755 nt, Artificial Sequence
  derived and/or modified sequence opt3 from hemagglutinin__InfluenzaB__ACF54268
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauugacgccgaaaaggcuccagggggacccuaucggcucggcaccucaggcagcugcccuaaugcaacaaguaaauccggguucuuugccaccauggcuugggccguaccacgcgagaacaauaagacggcgacuaacccgcugacaguugaagugccccacaucuguaccaaagaggaggaucagauuacugucuggggauuccauucugacaauaagauccagaugaagaaccuguacggugauagcaauccucaaaaauuuacauccucagcaaacggcauaaccacgcacuaugugagucagauugggggauucccagaccagaccgaagauggcggucucccccagagcgggagaaucguggucgacuacaugguucaaaagccuggaaaaacaggcacuauuguguaucagaggggcaucuuacugccacagaagguauggugcgccucugggcgguccaaagugaucaagggaucacuucccuugauuggugaggcugauugucugcacgaaaaauacggcgggcuaaauaagagcaagccguauuacaccggagagcaugccaaagcaauaggcaacugcccuaucugggucaagacaccccucaaacuggcuaacgguacuaaguaccgcccuccagccaaacuucugaaggagcgaggguuuuucggcgcgauugccggauuuuuggaaggcgggugggagggaaugaucgcagguuggcacggcuauaccagucauggggcucacggaguggccguugcugccgaccucaagucuacacaggaagcaauaaauaaaauuaccaagaacuuaaauucccugagcgagcuggaagugaaaaaccuccaaagacuuucgggcgccauggaugagcugcacaaugagaucuuggaacuagacgagaaggucgacgaucugagggcugacacuaucucuucccagauugaacucgcggugcugcuuucaaacgaggguaucauuaauagugaagaugagcaucuguuggcacucgagcggaaacugaagaagauguuagggcccagcgccauagacaucggcaacggauguuucgaaacgaaacacaagugcaaucagacaugccuggaucguauugcugccggcaccuuuaacgcaggggaguucucccuaccaacuuuugacucucucaauaucaccgccgcuagccugaacgaugacggacuugauaaucauacaaucuugcuguacuauucaaccgccgcaaguucccucgcgguaacucugaugauugcuauauucaucguuuacaugauuagccgcgacaacgugucuuguucaaucugccuuuga

SEQ ID NO: 148566 - RNA, 1755 nt, Artificial Sequence
  derived and/or modified sequence opt3 from hemagglutinin__InfluenzaB__ACF54279
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauugacgccgaaaaggcuccagggggacccuaucggcucggcaccucaggcagcugcccuaaugcaacaaguaaauccggguucuuugccaccauggcuugggccguaccacgcgagaacaauaagacggcgacuaacccgcugacaguugaagugccccacaucuguaccaaagaggaggaucagauuacugucuggggauuccauucugacaauaagacacagaugaagaaccuguacggugauagcaauccucaaaaauuuaccuccucagcaaacggcaucacgacccacuaugugagucagauagggggauucccagaccagacagaagauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaggcugauugucugcacgaaaaauacggcgggcuaaauaagagcaagccguauuacacaggagagcaugccaaagcaauuggcaacugcccuauaugggucaagacuccccucaaacuggcuaacgguaccaaguaccgcccuccagccaaacuucugaaggagcgaggguuuuucggcgcgaucgccggauuuuuggaaggcgggugggagggaaugauugcagguuggcacggcuauacaagucauggggcucacggaguggccguugcugccgaccucaagucuacccaggaagcaaucaauaaaauaacuaagaacuuaaauucccugagcgagcuggaagugaaaaaccuccaaagacuuucgggcgccauggaugagcugcacaaugagauuuuggaacuagacgagaaggucgacgaucugagggcugacacgaucucuucccagaucgaacucgcggugcugcuuucaaacgaggguauuaucaauagugaagaugagcaucuguuggcacucgagcggaaacugaagaagauguuagggcccagcgccguagacauuggcaacggauguuucgaaacaaaacacaagugcaaucagaccugccuggaucguauagcugccggcacuuuuaacgcaggggaguucucccuaccaaccuuugacucucucaauaucacagccgcuagccugaacgaugacggacuugauaaucauaccauuuugcuguacuauucaacugccgcaaguucccucgcgguuacacugaugaucgcuaucuucauuguguacaugauaagccgcgacaacgucucuuguucaaucugccuuuga

SEQ ID NO: 148567 - RNA, 1755 nt, Artificial Sequence
  derived and/or modified sequence opt3 from hemagglutinin__InfluenzaB__ACF54290
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaguugaugcagaaaacgccccagggggacccuaccgccucggcaccucaggcagcugcccuaaugcuacaaguaaguccggguucuuugcaaccauggccugggcugugccaaaagacaacaauaagaacgccacgaauccgcugacugucgaggugcccuauguguguacagaaggagaggaucagaucaccgucugggguuuccauucugacaaaaagacucagaugaaaaaccuguacggcgauagcaauccucaaaaguuuacauccucagcgaacgggguuaccacgcacuaugugagucagauuggaggcuucccagcacagaccgaggacggugggcucccccagagcggaagaaucguaguggauuacaugguccaaaagccuaggaaaacaggcacuauuguguaucagcggggcguuuuacugccacagaagguguggugcgccucugggcgcuccaaagucaucaagggaucacuucccuugauaggugaagcugacugucugcaugagaaauacggcgggcuaaacaagagcaaaccguacuauaccggagaacacgccaaggcaauuggcaauugcccuaucugggugaagacaccccucaaacuggcuaacgguacuaaguaccgaccuccagccaaacuucugaaggagagaggguuuuucggcgcgauugccggauuuuuggagggcgggugggaaggaaugaucgcagguuggcacggcuauaccagucauggggcucacggaguagccguugcugccgaucucaaaucuacacaggaggcaaucaauaagauuaccaagaacuuaaauucccugagcgaacuggaggugaaaaaccuccaaaggcuuucgggcgccauggacgaacugcauaaugagauauuggagcuagacgaaaaggucgaugaccugcgggcugauacuaucucuucccagauugagcucgcggugcugcuuucaaacgaagguaucauaaauagugaggacgaacaccuguuggcacucgagcguaaacugaagaaaauguuagggcccagcgccgucgauauuggcaacggauguuucgagacgaagcacaagugcaaucagacaugccuggacaaaaucgcugccggcaccuuuaacgcaggggaguucucccuaccaacuuuugauucucucaauaucaccgccgcuagccugaacgacgauggacuugacaaucauacaauuuugcuguacuauucaaccgccgcaaguucccucgcggugacucugaugcuugcuaucuucauuguuuacauggugagccgcgauaacguaucuuguucaauaugccuguga

SEQ ID NO: 148568 - RNA, 1758 nt, Artificial Sequence
  derived and/or modified sequence opt3 from hemagglutinin__InfluenzaB__ACF54312
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacucugaaacucagauggcuaagcuguauggggauagcaagccccagaaauuuacauccucaaguaacggagugaccacgcacuacauuagccaaaucggcgguuucccuaaccagaccgaggacgggggacugccacagucuggccggauugucguugauuauauggugcagaaguccggcaaaacagggacuaucaccuaccaacgcggaauccucuuaccccagaagguauggugcgccucagguagaagcaaagugauuaagggcagucugccucuuauaggggaagcggacuguuugcaugagaaauauggaggccugaauaagucuaagccauacuacacaggugagcacgcaaaagccaucgggaacugccccauuugggucaagacuccgcuaaaacucgcuaauggcaccaaguauaggccucccgccaaacugcuuaaggaacggggauuuuucggcgcaaucgcuggguuucuggagggagguugggaaggcaugauagccggguggcauggauacacaucccacggcgcgcacgguguggccguugcagcugaucucaagagcacccaggaggccauuaacaaaaucacuaagaauuugaacucgcugucugaauuagaggugaaaaaucugcagcgccucuccggggcuauggacgagcuucauaacgaaauccuggaguuggaugaaaaggucgacgaccuacgagccgauacgauuucaagucaaaucgagcuggcagugcuccugagcaaugaaggcauuauaaacuccgaggacgagcaccuucuggccuuggaaagaaaacucaagaagaugcugggaccaucugcuaucgagauuggcaauggguguuucgaaacaaaacauaagugcaaccagaccugcuuagauaggaucgcggcaggaacuuuugacgccggugaguucagccugccuaccuuugauucacuaaauaucacagcugccagucucaacgacgauggccuggacaaucacaccauucuuuuguauuacuccacugcagccagcucucuggcuguaacacucaugauagccaucuucguuguguauauggucucacgggauaacgugaguuguagcauuugccuguga

SEQ ID NO: 148569 - RNA, 1758 nt, Artificial Sequence
  derived and/or modified sequence opt3 from hemagglutinin__InfluenzaB__ACF54323
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacgcaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccauuccgacaacgaagcucagauggccaagcuguauggggauucuaaaccccagaaguuuacuagcuccgcgaauggagugacaacccacuacgucucacaaauuggcgguuucccuaaccagacggaggacgggggacugccacagaguggcagaaucguuguggauuauaugguacaaaagagcggcaaaaccgggacaauuacuuaccagaggggaauccucuuaccccagaagguguggugcgcaucuggucgguccaaagucaucaagggcucacugccucuuauuggggaagccgacuguuugcacgagaaauauggaggccugaauaagagcaaaccauacuacaccggugagcaugcuaaggccauagggaacugccccaucugggugaagacaccgcuaaaacucgcaaauggcacuaaguaucgcccucccgcuaaacugcuuaaggaacgaggauuuuucggcgccauugcgggguuucuggagggagguugggaaggcaugaucgccggguggcacggauacaccagucauggcgcacacgguguugcuguggccgcugauuugaaaucuacacaggaggccauaaacaagauuaccaagaaucucaacucccugagcgaauuagaggucaaaaaucugcagagacucucgggggcaauggacgagcuucacaacgaaauccuggaguuggaugaaaagguggacgaccuaagggccgauacuaucucuucccaaauugagcuggcuguacuccugucaaaugaaggcaucauuaacagugaggacgagcaucuucuggcguuggaacggaaacucaagaaaaugcugggaccaagcgcaguugagauaggcaauggguguuucgaaacgaagcacaagugcaaccagacaugcuuagaucguaucgccgcuggaaccuuugacgccggugaguucucccugccuacuuuugauucucuaaauauuaccgcagccagccucaacgacgauggccuggacaaccauacaauccuuuuguauuacucaaccgcugccaguucccuggcagugacucucaugaucgcgauuuucgucguguauauggucagccgcgauaaugugucuuguucaauaugccuguga

SEQ ID NO: 148570 - RNA, 1755 nt, Artificial Sequence
  derived and/or modified sequence opt3 from hemagglutinin__InfluenzaB__ACF54345
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaaggcacagaugaaaaaccuguacggcgauagcaauccccaaaaguuuacuuccucagccaacggggugacaacccacuaugucagucagauuggaggcuucccugaccagacggaggauggugggcucccacagagcggaagaaucguuguggacuacaugauacaaaagcccggcaaaaccggcacaauuguauaucagcgcgggguguuacugccucagaaggucuggugcgcuucuggacgguccaaagugaucaaggguucacuuccauugauuggcgaagccgauugucugcaugagaaauacgggggacuaaacaagagcaaacccuacuauacuggcgaacacgcaaaggcuaucgguaauugcccgaucuggguuaagaccccucucaaacuggccaacgggacaaaguacaggcccccagcgaaacuucugcgagagagaggcuuuuucggagccauugcaggcuuuuuggaagggggaugggaagguaugauagcuggcuggcacggguauacuucccauggagcccacggcguggcugucgccgcagaccucaagucuacccaggaggccaucaauaaaauuacaaagaaccugaauaguuuaagcgaacuggaggugaagaaccuccaaaggcuuucgggugcuauggacgaacugcauaaugagaucuuggagcuagaugaaaaaguagacgaucugcgggcggacaccauaucuucccagauugagcucgcaguucugcuuucaaacgaagggaucaucaauagugaggaugaacaccuguuggcccucgagcguaagcugaaaaagauguuaggcccuagcgcuguggacauuggaaacggcuguuucgagacuaaacacaagugcaaucagacgugccuggaucgcaucgccgcagggacauuuaacgccggagaguucucccuacccaccuuugacucucucaauauuacugcugccagccugaacgaugacggucuugauaaucauaccauauugcuguacuauucaacagcagcgaguucccucgcugucacccugaugcuugccaucuucauuguguacauggucagcagagacaacgugucuuguucaaucugccuguga

SEQ ID NO: 148571 - RNA, 1755 nt, Artificial Sequence
  derived and/or modified sequence opt3 from hemagglutinin__InfluenzaB__ACF54367
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccgccccaacaaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacuggccaaucuucugagggguuaugagaacauacgguugucgacacagaauguaaucgaugcugaaaaggcaccugggggaccauaccgccucggcacuucaggcagcugccccaacgccaccaguaaauccggguucuuugcuacaauggccugggcgguuccuaaggacaauaacaaaaaugcaaccaacccacugacgguggaggucccguauauuuguacugaaggagaggaucagaucacagugugggguuuccauucugacagcaagacccagaugaaaaaucuguacggcgauuccaacccccaaaaguuuacuucaagugccaauggggugacaacccacuaugucagccagauuggaggcuucccugaccagacggaggauggugggcucccacagucuggaagaaucguuguggacuacaugaugcaaaagcccggcaaaaccggcacaauaguauaucagcgcgggguguuacugccucagaaggucuggugcgcuuccggacggucaaaagugauuaaggguagccuuccauugaucggcgaagccgauugucugcaugagaaauacgggggacuaaacaagaguaaacccuacuauacuggcgaacacgcaaaggcuauugguaacugcccgaucuggguuaagaccccucucaaacuggccaaugggacaaaguacaggcccccagcgaaacuucugaaggagcgaggcuuuuucggagccaucgcaggcuuuuuggaagggggaugggaagguaugauugcuggcuggcacggguauacuucucauggagcccacggcguggcugucgccgcagaccucaaauccacccaggaggccauaaacaagaucacaaagaaucugaacagcuuaucggaacuggaggugaaaaaucuccaaagacuuucuggugcuauggacgaacugcauaacgagauuuuggagcuagaugaaaagguagacgaucugagggcggacaccaucuccucacagauagagcucgcaguucugcuuaguaaugaagggauuaucaacagcgaggaugaacaccuguuggcccucgagcggaaacugaagaaaauguuaggcccuuccgcuguggacaucggaaauggcuguuucgagacuaagcacaagugcaaccagacgugccuggaucguauugccgcagggacauuuaaugccggagaguucucucuacccaccuuugacagccucaacaucacugcugccucacugaaugaugacggucuugauaaccauaccauuuugcuguacuauaguacagcagcguccagccucgcugucacccugaugcuugccauauucaucguguacauggucucucgcgacaaugugucauguaguauuugccuguga

SEQ ID NO: 148572 - RNA, 1755 nt, Artificial Sequence
  derived and/or modified sequence opt3 from hemagglutinin__InfluenzaB__ACN32556
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccuucgcaaauggcaucacgacccacuaugugucacagauagggggauuuccagaccagacagaggauggcggucucccccagagugggagaauuguggucgacuacaugguucaaaagccuggaaaaacuggcaccaucguguaucagaggggcauuuuacugccacagaagguauggugcgccagcgggcggucuaaagugaucaagggaucccuucccuugaucggugaagcugauugucugcacgagaaauacggcgggcuaaacaagucaaagccguauuacacaggagaacaugccaaagcaauuggcaacugcccuauaugggucaagacuccccucaaacuggcuaaugguaccaaguaccgcccuccagccaaacuucugaaggagcgaggguucuuuggcgcgaucgccggauucuuggagggcgggugggaaggaaugauugcagguuggcacggcuauacaagccauggggcucacggaguggccguugcugccgaccucaagaguacccaggaggcaaucaacaaaauaacuaagaaucugaacucuuuauccgaacuggaggugaaaaaucuccaaagacuuagcggcgccauggaugaacugcacaacgagauuuuggagcuagacgaaaaggucgacgaucugagggcugacacgaucucgucucagaucgagcucgcggugcugcuuuccaaugaagguauuaucaacucagaggaugaacaucuguuggcacucgagcggaaacugaagaagauguuagggcccagugccguagacauuggcaauggauguuuugagacaaaacacaagugcaaccagaccugccuggaucguauagcugccggcacuuucaaugcaggggaauuuagccuaccaaccuucgacucccucaacaucacagccgcuucucugaaugaugacggacuugauaaccauaccauuuugcuguacuauagcacugccgcaucaagucucgcgguuacacugaugaucgcuaucuucauuguguacaugauaucccgcgacaaugucagcuguucuaucugccuuuga

SEQ ID NO: 148573 - RNA, 1758 nt, Artificial Sequence
  derived and/or modified sequence opt3 from hemagglutinin__InfluenzaB__ACN32567
auggaagccaucauugugcugcucauggucguuaccagcaacgcugacagaauaugcacaggcaucacuuccucuaauucaccccacgugguaaagacggcaacccagggggaagugaacgucacaggagugauuccucuuacuaccacaccaaccaaaagucauuucgccaaucugaaggguacugagacaaggggcaaauuguguccgaagugcuuaaacuguaccgaucuggacguugcgcuagggcggcccaaaugcacgggaaauaucccuagcgcucgcguguccauucuccacgaaguccgaccagugacuucuggcuguuuucccaucaugcaugaucguaccaagauaagacaacugccuaaccuucugagggguuacgagcacauccgguugucgacacauaauguaauuaacgccgaaaaugcaccagggggacccuauaagaucggcacuucaggcagcugcccuaacguuaccaaugggaacggauucuuugccacaauggcuugggcagugccaaagaaugacaacaauaagaccgccacgaacagucucacuauugaggucccguacaucuguacagagggugaagaucagauaaccguguggggcuuccacuccgacaacgagacucagauggcuaaacuguauggggauucuaagccccagaaauuuacaagcuccgccaauggagugaccacgcacuacgucucacaaauuggcgguuucccuaaccagaccgaagacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaggcagacuguuugcaugagaaguauggaggccugaauaaaagcaagccauacuacacaggugaacacgccaaagcuauagggaacugccccaucugggugaagacuccgcuaaagcucgccaauggcaccaaauaucggccucccgcaaagcugcuuaaagagcgcggauuuuucggcgcuauugccggguuucuggaaggagguugggagggcaugaucgcgggguggcauggauacacaagucacggcgcccacgguguugcaguggcugccgauuugaagucuacccaggaagcuauaaacaaaauuacuaagaaucucaacucccugagcgaguuagaggucaagaaucugcagcgacucucgggggccauggacgaacuucauaacgagauccuggaauuggaugagaaaguggacgaccuaagagcagauacgaucucuucccaaauugaacuggccguacuccugucaaaugagggcaucauuaacagugaggacgaacaccuucuggcuuuggagaggaagcucaaaaagaugcugggaccaagcgcgguugaaauaggcaauggguguuucgagacaaaacauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 148574 - RNA, 1758 nt, Artificial Sequence; identical to SEQ ID NO: 148530
  derived and/or modified sequence opt3 from hemagglutinin__InfluenzaB__ACN32578

SEQ ID NO: 148575 - RNA, 1758 nt, Artificial Sequence
  derived and/or modified sequence opt3 from hemagglutinin__InfluenzaB__ACN32589
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacaacaauaaaaccgcaacgaacucccucacuauugaagucccguacaucuguacagagggugaggaucagauaaccauuuggggcuuccacucugacaacgaaacucagauggccaagcuguauggggauagcaaaccccagaaguuuacauccucagcuaauggagugaccacgcacuacgugagucaaaucggcgguuucccuaaccagaccgaggacgggggacugccacagagcggccgcauugucguugauuauauggugcagaagucuggcaaaacagggacuaucaccuaccaaagaggaauccucuuaccccagaagguauggugcgccuccgguaggucaaaagugauuaagggcagccugccucuuauaggggaagcggacuguuugcaugagaaauauggaggccugaauaagaguaaaccauacuacacaggugagcacgcaaaggccaucgggaacugccccauuugggucaagacuccgcuaaaacucgcuaauggcaccaaguaucggccucccgccaaacugcuuaaggaacgcggauuuuucggcgcaaucgcuggguuucuggagggagguugggaaggcaugauagccggguggcauggauacacaucucacggcgcgcacgguguggccguugcagcugauuugaaauccacccaggaggccauuaacaagaucacuaagaaucucaacagccugucggaauuagaggugaaaaaucugcagcgacucucuggggcuauggacgagcuucauaacgaaauccuggaguuggaugaaaaggucgacgaccuaagagccgauacgauuuccucacaaaucgagcuggcagugcuccugaguaaugaaggcauuauaaacagcgaggacgagcaccuucuggccuuggaaaggaaacucaagaaaaugcugggaccauccgcuguagagaucggcaauggguguuucgaaacaaagcauaagugcaaccagaccugcuuagaucggauugcggcaggaacuuuugacgccggugaguucucucugccuaccuuugauagccuaaauaucacagcugccucacucaacgacgauggccuggacaaccacaccauccuuuuguauuacaguacugcagccuccagccuggcuguuacacucaugauugccauauucguggucuauauggugucucgugauaaugucucauguaguaucugccuguga

SEQ ID NO: 148576 - RNA, 1758 nt, Artificial Sequence
  derived and/or modified sequence opt3 from hemagglutinin__InfluenzaB__ACN32600
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacaacaauaaaaccgcaacgaacucccucacuauugaagucccguacaucuguacagagggugaggaucagauaaccguguggggcuuccacucugacaacgaaacucagauggccaagcuguauggggauagcaaaccccagaaguuuacauccucagcuaauggagugaccacgcacuacgucagucaaauuggcgguuucccuaaccagaccgaggacgggggacugccacagagcggccgcaucguuguggauuauaugguacagaagucuggcaaaacagggacuauuaccuaccaaagaggaauccucuuaccccagaagguguggugcgccuccgguaggucaaaagucaucaagggcagccugccucuuauuggggaagcggacuguuugcaugagaaauauggaggccugaauaagaguaaaccauacuacacaggugagcacgcaaaggccauagggaacugccccaucugggugaagacuccgcuaaaacucgcuaauggcaccaaguaucggccucccgcccgccugcuuaaagaacgaggauuuuucggcgcaauugcuggguuucuggagggagguugggaaggcaugaucgccggguggcauggauacacaucucacggcgcgcacgguguugccguggcagcugauuugaaguccacccaggaggccauaaacaaaauuacuaagaaucucaacagccugucggaauuagaggucaagaaucugcagagacucucuggggcuauggacgagcuucauaacgaaauccuggaguuggaugaaaaaguggacgaccuaagggccgauacgaucuccucacaaauugagcuggcaguacuccugaguaaugaaggcaucauuaacagcgaggacgagcaccuucuggccuuggaacggaagcucaaaaagaugcugggaccauccgcuguugagauaggcaauggguguuucgaaacaaaacauaagugcaaccagaccugcuuagaucguaucgcggcaggaacuuuugacgccggugaguucucucugccuaccuuugauagccuaaauauuacagcugccucacucaacgacgauggccuggacaaccacaccauccuuuuguauuacaguacugcagccuccagccuggcugugacacucaugaucgccauuuucgucguguauauggucucucgcgauaaugugucauguaguauaugccuguga

SEQ ID NO: 148577 - RNA, 1758 nt, Artificial Sequence; identical to SEQ ID NO: 148541
  derived and/or modified sequence opt3 from hemagglutinin__InfluenzaB__ACN32611

SEQ ID NO: 148578 - RNA, 1755 nt, Artificial Sequence; identical to SEQ ID NO: 148442
  derived and/or modified sequence opt3 from hemagglutinin__InfluenzaB__ACN32716

SEQ ID NO: 148579 - RNA, 1758 nt, Artificial Sequence; identical to SEQ ID NO: 148530
  derived and/or modified sequence opt3 from hemagglutinin__InfluenzaB__ACN32771

SEQ ID NO: 148580 - RNA, 1758 nt, Artificial Sequence; identical to SEQ ID NO: 148536
  derived and/or modified sequence opt3 from hemagglutinin__InfluenzaB__ACN32782

SEQ ID NO: 148581 - RNA, 1758 nt, Artificial Sequence
  derived and/or modified sequence opt3 from hemagglutinin__InfluenzaB__ACO05957
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaauucagauggcuaagcuguauggggauucuaaaccccagaaguuuacuagcuccgccaauggagugacaacccacuacgucucacaaaucggcgguuucccuaaccagacggaggacgggggacugccacagaguggccgcauuguuguggauuauaugguacaaaagagcggcaaaaccgggacaaucacuuaccagagaggaauccucuuaccccagaagguguggugcgcgucugguagguccaaagucauuaagggcucacugccucuuauaggggaagcagacuguuugcaugagaaauauggaggccugaauaagagcaaaccauacuacaccggugagcacgccaaggcuaucgggaacugccccauuugggugaagacaccgcuaaaacucgccaauggcacuaaguaucggccucccgcaaaacugcuuaaggaacgcggauuuuucggcgcuaucgccggguuucuggagggagguugggaaggcaugauagcgggguggcauggauacaccagucacggcgcccacgguguugcaguggcugccgauuugaaaucuacacaggaggcuauuaacaagaucaccaagaaucucaacucccugagcgaauuagaggucaaaaaucugcagcgacucucgggggccauggacgagcuucauaacgaaauccuggaguuggaugaaaagguggacgaccuaagagcagauacuauuucuucccaaaucgagcuggccguacuccugucaaaugaaggcauuauaaacagugaggacgagcaccuucuggcuuuggaaaggaaacucaagaaaaugcugggaccaagcgcgguugagaucggcaauggguguuucgaaacgaagcauaagugcaaccagacaugcuuagaucggauugcagccggaaccuuugacgcuggugaguucucccugccuacuuuugauucucuaaauaucaccgccgcaagccucaacgacgauggccuggacaaccacacaauccuuuuguauuacucaaccgccgcuaguucccuggccgugacucucaugauugcaauauucgucguguauauggucagccgugauaaugugucuuguucaaucugccuguga

SEQ ID NO: 148582 - RNA, 1755 nt, Artificial Sequence
  derived and/or modified sequence opt3 from hemagglutinin__InfluenzaB__ACO05968
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaagagaggaucagaucaccguguggggauuccauucugacaauaagacucagaugaaaaaccuguacggugauagcaauccucaaaaguuuacauccucagcgaacggcgugaccacgcacuaugucagucagauugggagcuucccagaccagaccgaggauggaggccucccccagucugguaggaucguuguggacuacaugaugcaaaagccugggaaaacaggaacuauaguauaucagcggggcguguuacugccacagaaggucuggugcgcauccggccgcucaaaagugauuaaggggagccuucccuugaucggagaagccgauugucugcaugagaaauacgguggccuaaacaagaguaaaccguacuauaccggggaacacgcuaaggccauuggaaauugcccuaucuggguuaagacaccccucaaacuggcaaacggcacuaaguaccgaccuccagcuaaacuucugaaggagagaggguuuuucggugccaucgcgggcuuuuuggagggaggcugggaagggaugauugccggauggcacgguuauaccucucauggcgcacacgggguggcugucgccgcugaccucaaauccacacaggaggccauaaauaagaucaccaagaaccugaauagcuuaucggaacuggaggugaaaaaccuccaaaggcuuucuggagcaauggacgaacugcauaaugagauuuuggagcuagaugaaaagguagacgaucugcgggccgacacuaucuccucacagauagagcucgcuguucugcuuaguaacgaaggcauuaucaauagcgaggaugaacaccuguuggcgcucgagcguaaacugaagaaaauguuaggucccuccgcaguggagaucgggaacggcuguuucgaaacgaagcacaagugcaaucagacaugccuggaccgcauugccgcuggaaccuuuaacgccggcgaguucucucuaccaacuuuugauagccucaauaucaccgcagccucacugaacgacgaugggcuugacaaucauacaauuuugcuguacuauaguaccgcugccuccagccucgcagucacucugaugcuugcgauauucaucguguacauggucucuagagauaacgugucauguaguauuugccuguga

SEQ ID NO: 148583 - RNA, 1755 nt, Artificial Sequence
  derived and/or modified sequence opt3 from hemagglutinin__InfluenzaB__ACO05979
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaagccuggaaaaacaggcacuauaguauaucagaggggcguguuacugccacagaaggucuggugcgcauccgggcggucaaaagugauuaagggaagccuucccuugaucggugaagccgauugucugcaugagaaauacggcgggcuaaacaagaguaaaccguacuauaccggagaacacgcuaaggccauuggcaauugcccuaucuggguuaagacaccccucaaacuggcaaacgguacuaaguaccgcccuccagcuaaacuucugaaggagcgaggguuuuucggcgccaucgcgggauuuuuggagggcgggugggaaggaaugauugccgguuggcacggcuauaccucucauggggcacacggaguggcugucgccgcugaccucaaauccacacaggaggccauaaauaagaucaccaagaaccugaauagcuuaucggaacuggaggugaaaaaccuccaaagacuuucuggcgcaauggacgaacugcauaaugagauuuuggagcuagaugaaaagguagacgaucugagggccgacacuaucuccucacagauagagcucgcuguucugcuuaguaacgaagguauuaucaauagcgaggaugaacaccuguuggcgcucgagcggaaacugaagaaaauguuagggcccuccgcaguggagaucggcaacggauguuucgaaacgaagcacaagugcaaucagacaugccuggaccguauugccgcuggcaccuuuaacgccggggaguucucucuaccaacuuuugauagccucaauaucaccgcagccucacugaacgacgauggacuugacaaucauacaauuuugcuguacuauaguaccgcugccuccagccucgcagucacucugaugcuugcgauauucaucguguacauggucucucgcgauaacgugucauguaguauuugccuguga

SEQ ID NO: 148584 - RNA, 1755 nt, Artificial Sequence; identical to SEQ ID NO: 148583
  derived and/or modified sequence opt3 from hemagglutinin__InfluenzaB__ACO05990

SEQ ID NO: 148585 - RNA, 1758 nt, Artificial Sequence
  derived and/or modified sequence opt3 from hemagglutinin__InfluenzaB__ACO06001
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaaaucagauggcuaagcuguauggggauucuaaaccccagaaguuuacuagcuucgccaacggagugacaacccacuacgucucccaaauuggcgguuuuccuaaucagacggaggacgggggacugccacagucaggccgcaucguuguggauuauaugguacagaagaguggcaaaaccgggacaauuacuuaccaaagaggaauccucuuaccccagaagguguggugcgcgagcgguaggucuaaagucaucaagggcucccugccucuuauuggggaagcagacuguuugcaugagaaauauggaggccugaacaagucaaaaccauacuacaccggugagcacgccaaggcuauagggaauugccccaucugggugaagacaccgcuaaaacucgccaacggcacuaaguaucggccucccgcaaaacugcuuaaggaacgcggauucuuuggcgcuauugccggguuccuggagggagguugggaaggcaugaucgcgggguggcauggauacaccagccacggcgcccacgguguugcaguggcugccgauuugaaaaguacacaggaggcuauaaauaagauuaccaagaaccucaauucucuguccgaauuagaggucaaaaaccugcagcgacucagcggggccauggacgagcuucauaaugaaauccuggaguuggaugaaaagguggacgaccuaagagcagauacuaucucgucucaaauugagcuggccguacuccuguccaacgaaggcaucauuaauucagaggacgagcaccuucuggcuuuggaaaggaaacucaagaaaaugcugggaccaagugcgguugagauaggcaacggguguuuugaaacgaagcauaagugcaaucagacaugcuuagaucggaucgcagccggaaccuucgacgcuggugaguuuagccugccuacuuucgauucccuaaacauuaccgccgcaucucucaacgacgauggccuggacaaucacacaauccuuuuguauuacagcaccgccgcuucaagucuggccgugacucucaugaucgcaauuuucgucguguauauggucucccgugauaacgugagcuguucuauaugccuguga

SEQ ID NO: 148586 - RNA, 1755 nt, Artificial Sequence; identical to SEQ ID NO: 148583
  derived and/or modified sequence opt3 from hemagglutinin__InfluenzaB__ACO06012

SEQ ID NO: 148587 - RNA, 1755 nt, Artificial Sequence; identical to SEQ ID NO: 148583
  derived and/or modified sequence opt3 from hemagglutinin__InfluenzaB__ACO06023

SEQ ID NO: 148588 - RNA, 1755 nt, Artificial Sequence
  derived and/or modified sequence opt3 from hemagglutinin__InfluenzaB__ACO06062
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauugacagcuucccagaucagaccgaggacggaggccucccccagucugguagaaucguuguggauuacaugaugcaaaagccugggaaaacaggaacuauaguauaucagaggggcguguuacugccacagaaggucuggugcgcauccggccggucaaaagugauuaaggggagccuucccuugaucggagaagccgacugucugcaugagaaauacgguggccuaaacaagaguaaaccguacuauaccggggaacacgcuaaggccauuggaaauugcccuaucuggguuaagacaccccucaaacuggcaaacggcacuaaguaccgcccuccagcuaaacuucugaaggagcgaggguuuuucggugccaucgcgggcuuuuuggagggaggcugggaagggaugauugccggauggcacgguuauaccucucauggcgcacacgggguggcugucgccgcugaccucaaauccacacaggaggccauaaauaagaucaccaagaaccugaauagcuuaucggaacuggaggugaaaaaccuccaaagacuuucuggagcaauggaugaacugcauaaugagauuuuggagcuagacgaaaagguagaugaccugagggccgauacuaucuccucacagauagagcucgcuguucugcuuaguaacgaaggcauuaucaauagcgaggacgaacaccuguuggcgcucgagcggaaacugaagaaaauguuaggucccuccgcaguggagaucgggaacggcuguuucgaaacgaagcacaagugcaaucagacaugccuggaucguauugccgcuggaaccuuuaacgccggcgaguucucucuaccaacuuuugacagccucaauaucaccgcagccucacugaacgaugacgggcuugauaaucauacaauuuugcuguacuauaguaccgcugccuccagccucgcagucacucugaugcuugcgauauucaucguguacauggucucucgcgacaacgugucauguaguauuugccuguga

SEQ ID NO: 148589 - RNA, 1758 nt, Artificial Sequence
  derived and/or modified sequence opt3 from hemagglutinin__InfluenzaB__ACO94661
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuuacaaccauggccugggcugugccaaagaaugacaacaauaaaacggcaacuaacagucucacaauugaagucccguacaucuguaccgagggugaggaucagauaacuguguggggcuuccacuccgacaacgaaacacagauggccaagcuguauggggauucuaaaccccagaaguuuaccagcuccgcuaauggagugacgacccacuacgucucacaaauuggcgguuucccuaaccagacagaggacgggggacugccacagaguggccgcaucguuguggauuauaugguacaaaagagcggcaaaacugggaccauuacauaccagagaggaauccucuuaccccagaagguguggugcgccucugguagguccaaagucaucaagggcucacugccucuuauuggggaagcggacuguuugcaugagaaauauggaggccugaauaagagcaaaccauacuacacuggugagcacgcaaaggccauagggaacugccccaucugggugaagaccccgcuaaaacucgcuaauggcacaaaguaucggccucccgccaaacugcuuaaggaacgcggauuuuucggcgcaauugcuggguuucuggagggagguugggaaggcaugaucgccggguggcauggauacaccagucacggcgcgcacgguguugccguggcagcugauuugaaaucuacucaggaggccauaaacaagauuacgaagaaucucaacucccugagcgaauuagaggucaaaaaucugcagcgacucucgggggcuauggacgagcuucauaacgaaauccuggaguuggaugaaaagguggacgaccuaagagccgauacaaucucuucccaaauugagcuggcaguacuccugucaaaugaaggcaucauuaacagugaggacgagcaccuucuggccuuggaaaggaaacucaagaaaaugcugggaccaagcgcuguugagauaggcaauggguguuucgaaaccaagcauaagugcaaccagacuugcuuagaucggaucgcggcaggaaccuuugacgccggugaguucucccugccuacauuugauucucuaaauauuaccgcugccagccucaacgacgauggccuggacaaccacacuauccuuuuguauuacucaacagcagccaguucccuggcugugacgcucaugaucgccauuuucgucguguauauggucagccgugauaaugugucuuguucaauaugccuguga

SEQ ID NO: 148590 - RNA, 1758 nt, Artificial Sequence; identical to SEQ ID NO: 148530
  derived and/or modified sequence opt3 from hemagglutinin__InfluenzaB__ACR15622

SEQ ID NO: 148591 - RNA, 1758 nt, Artificial Sequence
  derived and/or modified sequence opt3 from hemagglutinin__InfluenzaB__ACR15633
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacucugaaacucagauggcuaagcuguauggggauagcaaaccccagaaguuuacauccucagccaacggagugaccacgcacuacgucagucaaauuggcgguuucccuaaucagaccgaggacgggggacugccacagagcggccgcaucguuguggauuauaugguacagaagucuggcaaaacagggacuauuaccuaccaaagaggaauccucuuaccccagaagguguggugcgcguccgguaggucaaaagucaucaagggcagccugccucuuauuggggaagcagacuguuugcaugagaaauauggaggccugaacaagaguaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaucucacggcgcccacgguguugcaguggcugccgauuugaaauccacccaggaggcuauaaauaagauuacuaagaaccucaauagccugucggaauuagaggucaaaaaccugcagcgacucucuggggccauggacgagcuucauaaugaaauccuggaguuggaugaaaagguggacgaccuaagagcagauacgaucuccucacaaauugagcuggccguacuccugaguaacgaaggcaucauuaauagcgaggacgagcaccuucuggcuuuggaaaggaaacucaagaaaaugcugggaccauccgcgguugagauaggcaacggguguuucgaaacaaagcauaagugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccgugacacucaugaucgcaauuuucgucguguauauggucucucgugauaacgugucauguaguauaugccuguga

SEQ ID NO: 148592 - RNA, 1755 nt, Artificial Sequence
  derived and/or modified sequence opt3 from hemagglutinin__InfluenzaB__ACR15644
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaauccagaugaagaaucuguacggcgauagcaacccucaaaaauuuacuuccucagcgaacggggucacaacccacuauguuagucagauuggaggcuucccagcacagacggaggacggugggcucccccagagcggaagaaucgugguagauuacauggugcaaaagccuaggaagaccggcacaauagucuaucagcggggcguguuacugccacagaaaguuuggugcgccucugggcgcuccaaggugauuaaaggaucacuucccuugaucggugaagcugacugucugcaugagaaguacggcgggcuaaauaaaagcaagccguacuauacuggagaacacgccaaagcaauuggcaacugcccuaucugggucaagacuccccucaagcuggcuaaugguacaaaauaccgaccuccagccaaacuucugaaggagagaggguuuuucggcgcgaucgccggauuuuuggagggcgggugggaaggaaugauugcagguuggcacggcuauaccagucauggggcucacggaguggccguagcugccgaucucaagucuacccaggaggcaauaaacaaaaucacaaagaaucugaacuccuuaagcgaacuggagguuaagaaucuccaaaggcuuucgggcgccauggacgaacugcauaacgagauuuuggagcuagacgaaaaaguggaugaccugcgggcugauaccaucucuucccagauagagcucgcgguccugcuuucaaaugaagguauuaucaacagugaggacgaacaccuguuggcacucgagcguaagcugaaaaagauguuagggcccagcgccguggauaucggcaauggauguuucgagacuaaacacaagugcaaccagacgugccuggaccgcauugcugccggcacauuuaaugcaggggaguucucccuaccaaccuuugauucucucaacaucacugccgcuagccugaaugacgauggacuugacaaccauaccauuuugcuguacuauucaacagccgcaaguucccucgcggucacccugaugcuugcuauauucaucguguacaugguuagcagagauaacgugucuuguucaauuugccuguga

SEQ ID NO: 148593 - RNA, 1758 nt, Artificial Sequence
  derived and/or modified sequence opt3 from hemagglutinin__InfluenzaB__ACR15655
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacucugaaacucagauggcuaagcuguauggggauagcaaaccccagaaguuuacauccucagccaacggagugaccacgcacuacgucagucaaauuggcgguuucccuaaucagaccgaggacgggggacugccacagagcggccgcaucguuguggauuauaugguacagaagucuggcaaaacagggacuauuaccuaccaaagaggaauccucuuaccccagaagguguggugcgcguccgguaggucaaaagucaucaagggcagccugccucuuauuggggaagcagacuguuugcaugagaaauauggaggccugaacaagaguaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaucucacggcgcccacgguguugcaguggcugccgauuugaaauccacccaggaggcuauaaauaagauuacuaagaaccucaauagccugucggaauuagaggucaaaaaccugcagcgacucucuggggccauggacgagcuucauaaugaaauccuggaguuggaugaaaagguggacgaccuaagagcagauacgaucuccucacaaauugagcuggccguacuccugaguaacgaaggcaucauuaauagcgaggacgagcaccuucuggcuuuggaaaggaaacucaagaaaaugcugggaccauccgcgguugagauaggcaacggguguuucgaaacaaagcauaagugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccgugacacucaugaucgcaauuuucgucguguauauggucucucgugauaacauaucauguaguaucugccuguga

SEQ ID NO: 148594 - RNA, 1758 nt, Artificial Sequence
  derived and/or modified sequence opt3 from hemagglutinin__InfluenzaB__ACR15666
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcauaaccguaccaagauaagacaacugccuaaucuucugagggguuacgaacacauccgguugucgacacauaacguaauuaaugccgagaacgcaccagggggacccuauaaaaucggcacuucaggcagcugcccuaauguuaccaacgggaauggauucuuugccacaauggcuugggcagugccaaagaacgauaauaacaaaaccgccacgaacagucucacuauugaagucccguacaucuguacagagggugaggaccagauaaccguguggggcuuccacuccgaugacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 148595 - RNA, 1758 nt, Artificial Sequence
  derived and/or modified sequence opt3 from hemagglutinin__InfluenzaB__ACR15677
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauauuaccaacgggaauggauucuuugccacaauggcuugggcaguuccgaaaaacgacaauaacaagaccgccacgaauagucucacuaucgaggugccauacauauguacagaaggugaggaucagauuaccgucuggggcuuccacuccgacaacgaggcucagauggccaagcuguauggggauucuaaaccccagaaguuuacuagcuccgcgaacggagugacaacccacuacgugucacaaaucggcgguuucccuaaucagacggaagacgggggacugccacagaguggccggauugucguugauuauauggugcagaaaagcggcaagaccgggacaaucacuuaccaacgcggaauccucuuaccccagaaaguauggugcgcaucugguagauccaaggugauuaaaggcucacugccucuuauaggggaggccgacuguuugcaugaaaaguauggaggccugaacaagagcaaaccauacuacaccggugagcacgcuaaggccaucgggaauugccccauuugggucaaaacaccgcuaaagcucgcaaacggcacuaaauauaggccucccgcuaagcugcuuaaggagcggggauuuuucggcgccaucgcgggguuucuggaaggagguugggagggcaugauagccggguggcauggauacaccagucacggcgcacacgguguggcuguugccgcugauuugaaaucuacacaggaagccauuaauaagaucaccaaaaaccucaauucccugagcgaguuagaagugaagaaccugcagcgccucucgggggcaauggacgagcuucauaaugagauccuggaauuggaugagaaagucgacgaccuacgagccgauacuauuucuucccaaaucgaacuggcugugcuccugucaaacgagggcauuauaaauagugaagacgagcaccuucuggcguuggagagaaagcucaagaaaaugcugggaccaagcgcaguagaaaucggcaacggguguuucgagacgaagcauaaaugcaaucagacaugcuuagauaggauugccgcuggaaccuuugacgccggugaguucucccugccuacuuuugauucucuaaacaucaccgcagccagccucaaugacgauggccuggacaaccacacaauccuuuuguauuacucaaccgcugccaguucccuggcaguuacucucaugauugcgauauucguggucuauauggugagccgggauaacgucucuuguucaaucugccuguga

SEQ ID NO: 148596 - RNA, 1755 nt, Artificial Sequence; identical to SEQ ID NO: 148583
  derived and/or modified sequence opt3 from hemagglutinin__InfluenzaB__ACR15710

SEQ ID NO: 148597 - RNA, 1755 nt, Artificial Sequence
  derived and/or modified sequence opt3 from hemagglutinin__InfluenzaB__ACR15721
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacgauaauaagacggccacuaacccgcugacaguggagguccccuacguguguaccgaaggagaggaccagauuacugugugggguuuccacucugauaauaaagcgcagaugaagaaccuguauggcgacagcaauccucaaaaauuuacauccucagcaaacggggucaccacgcauuacguuagucagaucggaggcuucccagaucagaccgaggacggugggcucccccagagcggaaggauugugguagauuauauggugcaaaagccuggcaagacaggcacuaucgucuaccagcgcgggguguuacugccacagaaaguuuggugcgccucuggacgguccaaggugauaaaagguucacuucccuugauuggcgaagcugacugucugcacgagaaguaugggggacuaaacaaaagcaagccguacuacaccggcgaacacgccaaagcaaucgguaauugcccuauuugggucaagacaccccucaagcuggcuaacgggacuaaauaucgaccuccagccaagcugcugaaagagagaggcuuuuucggagcgaucgccggcuuuuuggaagggggaugggaagguaugaucgcaggcuggcauggguacaccagucacggagcucauggcguggccguagcugccgaucucaagucuacacaggaggcaauuaauaaaauaaccaagaaccuuaauuccuuaagcgaacuggagguuaagaaccuccaaaggcuuucgggugccauggacgaacugcacaaugagaucuuggagcuagacgaaaaaguggaugaccugcgggcugauacuauuucuucccagaucgagcucgcgguccugcuuucaaacgaagggauaauuaauagugaggacgaacaccuguuggcacucgagcguaagcugaaaaagauguuaggccccagcgccguggauaucggaaacggcuguuucgagacgaaacauaagugcaaucagacaugccuggaccgcaucgcugccgggaccuuuaacgcaggagaguucucccuaccaacuuuugauucucucaauauuaccgccgcuagccugaacgacgauggucuugacaaucacacaaucuugcuguauuacucaaccgccgcaaguucccucgcggucacucugaugauugcuauauucaucguguauaugguuagcagagauaacgugucuuguucaauuugccuuuga

SEQ ID NO: 148598 - RNA, 1758 nt, Artificial Sequence
  derived and/or modified sequence opt3 from hemagglutinin__InfluenzaB__ACR39336
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaagcucagauggccaagcuguauggggauucuaaaccccagaaguuuacuagcuccgcgaauggagugacaacccacuacgucucacaaauuggcgguuucccuaaccagacggaggacgggggacugccacagaguggccgcaucguuguggauuauaugguacaaaagagcggcaaaaccgggacaauuacuuaccagagaggaauccucuuaccccagaagguguggugcgcaucugguagguccaaagucaucaagggcucacugccucuuauuggggaagccgacuguuugcaugagaaauauggaggccugaauaagagcaaaccauacuacaccggugagcacgcuaaggccauagggaacugccccaucugggugaagacaccgcuaaaacucgcaaauggcacuaaguaucggccucccgcuaaacugcuuaaggaacgcggauuuuucggcgccauugcgggguuucuggagggagguugggaaggcaugaucgccggguggcauggauacaccagucacggcgcacacgguguugcuguggccgcugauuugaaaucuacacaggaggccauaaacaagauuaccaagaaucucaacucccugagcgaauuagaggucaaaaaucugcagcgacucucgggggcaauggacgagcuucauaacgaaauccuggaguuggaugaaaagguggacgaccuaagagccgauacuaucucuucccaaauugagcuggcuguacuccugucaaaugaaggcaucauuaacagugaggacgagcaccuucuggcguuggaaaggaaacucaagaaaaugcugggaccaagcgcaguugagauaggcaauggguguuucgaaacgaagcauaagugcaaccagacaugcuuagaucggaucgccgcuggaaccuuugacgccggugaguucucccugccuacuuuugauucucuaaauauuaccgcagccagccucaacgacgauggccuggacaaccacacaauccuuuuguauuacucaaccgcugccaguucccuggcagugacucucaugaucgcgauuuucgucguguauauggucagccgugauaaugugucuuguucaauaugccuguga

SEQ ID NO: 148599 - RNA, 1755 nt, Artificial Sequence
  derived and/or modified sequence opt3 from hemagglutinin__InfluenzaB__AEA51386
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauuauaaaaacgccacgaauccgcugacuguggagguccccuacauuuguacagaaggagagggucagaucaccguguggggcuuccauucugauaacaagccucagaugaaaaaucuguauggggacagcaacccacaaaaguuuacuuccucagcgaguggagugacaacccacuacgucagccagauuggcgauuuccccgaccagacggaggauggugggcucccucagucuggaagaaucguuguggacuauaugaugcaaaagccaggcaaaaccggcacaauaguauaccagaggggaguguuacugccccagaaggucuggugcgcauccgggcggucaaaagugauuaaggguagccuuccguugaucggcgaagccgauugucugcaugagaaauacgggggacuaaauaagaguaaaccuuauuacacuggcgaacacgcuaaggccauugguaacugccccaucuggguuaucaccccacagaagcucgcaaacgggacaacuuuuucuccucccgcuaaacugcuuaaggagcgcggcuucuuuggagccauugcgggcuuccuggaagggggaugggaggguaugauagccggcuggcacggguauaccucccauggagcacacggcguggcugucgccgcugacuugaaaagcacacaagaggccaucaauaagauuaccaaaaaccucaauucgcugucugaauuagaggugaagaaccugcagcgacucuccggugcaauggacgaacuucauaaugagauccuggaguuggaugaaaagguagacgaucuaagagccgacacuauaucaagucagauugagcuggcuguucuccugagcaacgaagggaucaucaauuccgaggaugaacaccuucuggcguuggagaggaaacucaagaaaaugcugggcccaucugcaguggacauuggaaacggcuguuuugagacgaagcacaaaugcaaucaaacaugcuuagaucggaucgccgcugggaccuucaacgccggagaauuuagccugcccacuuucgacucacuaaauauuaccgcagccagucucaacgaugacggucuggauaaucauacaauacuuuuguacuauuccaccgcugccagcucucuggcagucacucucaugcuggcgaucuucauuguguacauggucucacgugacaacgugaguuguagcaucugccuuuga

SEQ ID NO: 148600 - RNA, 1755 nt, Artificial Sequence
  derived and/or modified sequence opt3 from hemagglutinin__InfluenzaB__AEA51387
augaaggccaucauugugcugcucauggucguuaccagcaacgcugacagaauaugcacagagaucacuuccucuaauucaccccuugugguaaaaacggcaacccagggcgaagugaacgucacaggggugauuccucugacuaccacaccaaccaagaguuacuucgccaauuugaaaggaacuaggacacgggguaaguuauguccggauugccugaacuguaccgaccuagauguugcgcucggccgccccaugugcguggggacgacuccuagcgcuaaagccuccauccugcacgagguccgaccagugaccucuggauguuuucccauuaugcaugaccguacaaagaucagacaacuuccuaaucuguugaggggcuaugaaaacauacggcucucgacucagaauguaaucgaugcagagaaggccccaggugggcccuaccgccugggaaccucaggcagcugcccuaacgcuacaaguaaaauuggcuucuuugcaaccauggccugggcuguuccaaaggacaauuauaaaaacgccacgaauccgcugacuguggaaguccccuacaucuguacagagggggaggaucagauuaccguguggggauuccacuccgacaacaagacucagaugaaaaaucucuauggugauucuaacccucaaaaguuuacaagcuccgcgaauggcgugaccacgcauuacgucucacagaucggggacuucccagaucagaccgaagacggaggcuuaccccagagugguagaauaguuguggauuauaugaugcaaaagccugggaaaacaggaccaauuguauaccagaggggcgugcugcuuccccagaaggucuggugcgcaagcggccggucuaaagugaucaagggguccuugccgcugauuggagaggccgacugucuacacgaaaaauacgguggccucaacaagucaaaauauagccauacuggggaccacgcuaagacccugggaaacugcccuaucuggguuaagacaccccuuaaacuggccaauggcacuaaguaccgcccuccagcaaaauugcucaaggagcgagguuucuucggggcuaucgccggcuuucuggagggaggcugggaagggaugauugcgggauggcacgguuauaccagucauggcgcccacgggguggcagucgcugccgauuuaaaaucuacacaggaggcuauaaacaagaucaccaagaaucugaacucccucagcgaacuugaggugaaaaaucugcaaagauugucgggagccauggacgaacuacauaacgagauucuggagcucgaugaaaagguagacgaucugagggcagacacuaucucuucccagauagagcuugccguucuguugucaaaugaaggcauuaucaacagugaggaugaacaccuccuggcuuuagagcggaaacugaagaaaaugcuaggucccagcgcgguggacaucgggaauggcuguuucgagacgaagcacaagugcaaccagacaugccucgaucguauugcagccggaaccuuuaaugcuggcgaauuuucccugccaacuuuugacucucuuaacaucaccgccgccagcuugaaugaugacgggcuggacaaccauacaauucuccuguacuauucaaccgcagcuaguucccuugccgucacucugauguuggcaauauucaucguguacauggucagccgcgauaaugugucuuguucaauuugccucuga

SEQ ID NO: 148601 - RNA, 1755 nt, Artificial Sequence
  derived and/or modified sequence opt3 from hemagglutinin__InfluenzaB__AEA51388
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccgagcuauaccggagaacacgcuaaggccaagggcaacugcccuaucuggguuaauacaccccucaaacuggcaaacgguacuaaguaccgcccuccagcuaaacuuuuuaaggagcgaggguucuuuggcgccaucgcgggauuccuggagggcgggugggaaggaaugauugccgguuggcacggcuauaccagucauggggcacacggaguggcugucgccgcugacuugaaaucuacacaggaggccauaaauaagaucaccaagaaccucaauucccugagcgaauuagaggugaaaaaccugcaaagacucucgggcgcaauggaugaacuucauaaugagauucuggaguuggacgaaaagguagaugaccuaagggccgauacuaucucuucccagauagagcuggcuguucuccugucaaacgaagguauuaucaauagugaggacgaacaccuucuggcguuggagcggaaacucaagaaaaugcuggggcccagcgcaguggauaagggcaacggauguuuugagacgaagcacaaaugcaaucagacaugcuuagaccguaucgccgcuggcaccuucaacgccggggaauuuucccugccaacuuucgauucucuaaauauuaccgcagccagccucaacgacgauggacuggacaaucauacaauccuuuuguacuauucaaccgcugccaguucccuggcagucacucucaugcuggcgauuuucauaguguacauggucagccgcgacaacgugucuuguucaaucugccuuuga

SEQ ID NO: 148602 - RNA, 1755 nt, Artificial Sequence
  derived and/or modified sequence opt3 from hemagglutinin__InfluenzaB__AEA51389
augaaggccaucauugugcugcucauggucguuaccagcaacgcugacagaauaugcacaggcaucacuuccucuauuucaccccuuguggauaaaacggcaacccagggggagguaaaugugacaggagucaucccucugacuaccacaccaaccaagaguuacuucgccaacgugaaagguacuaggacacggggcaaguuguguccggacugcuuaaauuguaccgaucuggacguugcgcuagggcgccccaugugcgugggaacgacuccuagcgcuaaagccuccauucuccacgaaguccgaccagugaccucuggcuguuuucccaucaugcaugaucguacaaagauaagacaacugccuaaccuucugagggguuaugagaauauccgguugucgacucagaacguaauugacgcacagaaggccccagggggacccuaccgccucggcaccucaggcagcugcccuaaugcuacaaguaaaaucggguucuuugcaaccauggccugugcuguuccaaaggauaacuauaaaaaugccacgaacccgcugacuguggaaguccccuacauuagaacagagggagaagaccagaucaccgugugggguuuccacuccgauaauaagacucaaaugaaaaaccuguauggcgacucuaauccuccaaaguuuacaagcuccgcgaacggggugaccacgcauuacgucucacagaccggagauuuccccgaccagacagaggauggcggucucccuccaagugggaggauaguuguggacuauaugaugcagaagcccggaaaaacuggcaccauugcauaccaacggggcguauuacugccgcagaagguguggugcgccagcgggcgcucuaaagucaucaagggaucccuuccuuugauuggugaggcugacugucugcacgaaaaauacggcgggcuaaauaagucaaaacccccacauacaggagagcacacuaaggccaucggcaacugcccuaucugggugaagacaccccucaaacuggcaaacgguaccaaguaucgaccaagcgcuaaacuucugaaggaaagaggguuuuucggcgccauugcgggauuuuuggagggcgggugggagggaaugauagccgguuggcacggcuacaccagucauggggcacacggaguugcuguggccgcugaucucaaaucuacucaggaagccaucaauaagauuacgaagaacuuaaauucccugagcgagcuggaagucaaaaaccuccagaggcuuucgggcgcaauggacgagcugcauaaugaaaucuuggagcuagaugagaagguggacgaucugcgggccgacacaauaucuucccaaauugaacucgcuguacugcuuucaaacgaggguaucaucaauagugaagaugagcaccuguuggcgcucgaacguaaacugaagaaaauguuagggcccagcgcaguugacauuggcaacggauguuucgagaccaagcacaagugcaaucagacuugccuggaucgcaucgccgcuggcaccuuuaacgccggggaguucuuucuaccuacauucgacucccucaauauuaccgcagccucucugaacgaugacggacuugacaaucauacuauauugcuguauuacagcacagcugccucaagucucgcagugacgcugaugcuugcgaucuucauugucuauaugguguccagagauaacgucagcuguucuaucugccuguga

SEQ ID NO: 148603 - RNA, 1755 nt, Artificial Sequence
  derived and/or modified sequence opt3 from hemagglutinin__InfluenzaB__AEA51390
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcgguuuacccccuagugggagaauaguuguggauuauaugaugcagaagccaggaaaaacaggcacuauuguauaccaaaggggcgggcuccugccccagaagguguggugcgcaagcggacggucuaaagucaucaaggguucccuuccguugauuggcgaagccgacugucugcaugagaaauacgggggacuaaacaagucaaaaccuuauuacaccggcgaacacgcuaaggccaucgguaacugccccaucugggugaagccaccucucaaacuggcaaaugggacaaaguaucgacccccagcuaaacuuuuuaaggagcgcggcuucuuuggagcccuggcgggcuucuuggaagggggaugggaggguaugauugccggcuggcacggguacacuagccauggagcacacggcguugcuguggccgcugaccucaaaaguacccaggaggccauaaacaagaucacaaagaaucugaacucuuuauccgaacuggaggucaaaaaucuccagagacuuagcggugcaauggaugaacugcauaacgagauuuuggagcuagacgaaaagguggaugaccugagggccgauaccaucucgucucaaauagagcucgcuguacugcuuuccaaugaagggauuaucaacucagaggacgaacaccuguuggcgcucgagcggaaacugaagaaaauguuaggccccagugcaguugauaucggaaauggcuguuuugagacuaagcacaagugcaaccagacgugccuggaccguauugccgcugggacauucaaugccggagaauuuagccuaccuaccuucgauucccucaacaucacugcagccucucugaaugacgauggucuugacaaccauaccauuuugcuguauuacagcacagcugccucaagucucgcagugacccugaugcuugcgauauucaucgucuauauggugucccgcgacaaugucagcuguucuauuugccuguga

SEQ ID NO: 148604 - RNA, 1758 nt, Artificial Sequence
  derived and/or modified sequence opt3 from hemagglutinin__InfluenzaB__AEA51391
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugugaaugaaacucagauggcuaagcuguauggggacuccaagccucagaaauuuacaucuagcgccaacggagugaccacgcacuacaucucccaaauuggcgguuucccaaaccagaccgaggaugggggacugccccagucaggccgcaucgucguugacuauauggugcagaagaguggcaaaacagggacuaucaccuaccaaagagguauucucuuaccucagaagguauggugcgcgagcggaaggucuaaagugauaaagggcucccugccacuuaucggggaagcagauuguuugcaugagaaauauggaggccugaauaagucaaagcccuacuacacaggugagcacgccaaagcuauugggaacugcccgaucugggucaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacggugugccuguugcagcugacuugaagaguacccaggaggccaucaacaaaaucacuaagaaucucaacucucuguccgaauuagaggugaaaaaucugcagcgacucagcggggcuauggaugagcuucauaacgaaauucuggaguuggacgaaaaggucgaugaccuaagagccgacacgaucucgucucaaauugagcuggcagugcuccuguccaaugaaggcauaaucaacucagaggaugagcaccuucuggccuuggaaaggaaacucaagaagaugcugggacccagugcuguagagauuggcaauggguguuucgaaacaaaacauaagugcaaccagaccugcuuagaccggaucgcggcaggaacuuuugaugccggugaguucagccugccaaccuuugacucccuaaauaucacagcugccucucucaacgaugacggccuggauaaucacaccauucuuuuguauuacagcacugcagccucaagucuggcuguuacacucaugauagccaucuucguggucuauauggugucccgugacaacgucagcuguucuauuugccuguga

SEQ ID NO: 148605 - RNA, 1758 nt, Artificial Sequence
  derived and/or modified sequence opt3 from hemagglutinin__InfluenzaB__AEA51392
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggaggcaccacgcacuacgugucccaaauugguggguuccccaaccagaccgaggacggaggccugccucagucaggccgcaucgucguugauuauauggugcagaagagugggaaaacaggaacuauuaccuaccaaagagguauccugcucccacagaagguauggugcgcgagcggcaggucuaaagugaucaagggguccuuaccccugauuggagaagcagacugucuucaugagaaauauggcgguuugaauaagucaaagccguacuacacaggggagcacgccaaagcuauaggcaacugcccuaucugggucaagacuccccugaaacuagccaauggaaccaagaacauugcaccagcuaaacuccugaaggaacggggcuuuuucggggccaucgcgggauuucuugaggguggcugggaagggaugauagccggauggcauggcuauacaagccacggugcacacgggguggcuguugccgcugaucugaagaguacccaggaggccauuaauaaaaucacuaagaaccuuaauucucucuccgaacuggaggugaaaaacuuacagcgccugagcggcgcaauggacgagcuccauaaugaaauccuugagcuggaugaaaaggucgacgacuugcgagccgauacgauuucgucucaaaucgagcuagcugugcugcucuccaacgaaggaauuauaaauucagaggacgagcaccuguuggcgcuggaaagaaaauugaagaagaugcucggcccuagugcaguagagaucgggaacggauguuucgaaacaaaacauaagugcaaucagaccugccuggauaggauugccgcugguacuuuugacgccggcgaguucagcuuacccaccuuugauucccugaacaucacagcagccucucuaaaugacgaugggcucgacaaccacaccauccugcuuuacuauagcacugcugccucaaguuuggcaguuacacugaugauugcgauauucguggucuacauggugucccgggauaacgucagcuguucuaucugccucuga

SEQ ID NO: 148606 - RNA, 1755 nt, Artificial Sequence
  derived and/or modified sequence opt3 from hemagglutinin__InfluenzaB__AEA51395
augaaggccaucauugugcugcucauggucguuaccagcaacgcugacagaauaugcacaggcaucacuuccucuaauucaccccacgugguaaaaacggcaacccuuggggaagugaacgucacaggagugauuccucugacuaccacaccaaccaagaguuacuucgccaauuugaaagguacuaggacacggggcaaguuauguccggauugccugaacuguaccgaccuagauguugcgcucgggcgccccaugugcgugggaacgacuccuagcgcuaaagccuccauccugcaugaaguccgaccagugaccucuggcuguuuucccauuaugcacgaccguacaaagaucagacagcuuccuaaucuguugagggguuaugagaacauacggcucucgacucaaaauguaaucgaugcagaaaaggccccagggggacccuaccgccugggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucaguucaccgugugggguuuucauuccgacaacauuacucagcucaagaauuuauucggcgauucuaacccucagagauuuacaagcuccgcgaauggggugaccacgcacuaugucucacaaaucggagacuucccagaucagaccgaggacggcggucugccccagagugggaggauaguuguggauuacguaaugcagaaaccuggaaagacaggcacuauuguguaucaacggggcguccuuuugccacccaaggugugguuugcacgcgggcgaagcaaaguuaucaagggaucucugccgcuaauuggugaagccgacugcauccaugagaaauacggcgggcucaacaaguccaaaccuuacuauaccggagaacacgcuaaggccaucggcaacugucccauuugggugaaaacaccacugaaacuugcaaaugguacuaaguacagaccucccgcuaagcuguugaaggagaggggguucuuuggcgccauagcgggauuccucgagggcgggugggaaggaaugaucgccgguuggcacggcuauaccucacauggggcacacggagucgcuguggccgcugaccugaaaagcacacaggaggccauuaacaagaucaccaaaaauuuaaacagucugucugaacucgagguaaagaaucuucagcggcuguccggcgcaauggaugaauugcauaacgagauacuagagcuggacgaaaagguugaugaccuccgugccgauacuauuagcucgcagaucgagcuggcugugcuucugucuaaugaagguaucauuaacuccgaggacgaacacuugcucgcgcuggagcgcaaauuaaagaaaaugcuggggccaucagcagucgauaucggcaauggaugcuuugagacgaagcacaaauguaaccaaacaugccuagacagaauugccgcuggcaccuucaaugccggggaguucagucuccccacuuuugauagccugaacauaaccgcagccucccuuaaugacgauggauuggacaaccauacaauccugcucuacuauucuaccgcugccagcucacuggcagugacucuuaugcuggcgauuuucaucgucuacauggugaguagggacaauguuuccugcagcaucuguuuguga

SEQ ID NO: 148607 - RNA, 1758 nt, Artificial Sequence
  derived and/or modified sequence opt3 from hemagglutinin__InfluenzaB__AEA51398
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggauuggauucuuugccacaauggcuugggcagugccgaaaaaugacaagaacaaaaccgccacgaaucccuugacuaucgaagucccuuacauauguacagagggugaggaucagauuaccguguggggcuuccacagugacaacgaaacucagauggcuaagcucuauggggauuccaagccacagaaauuuacaucuagcgccaauggagugaccacgcacuacgucucccaaaucggcgguuuccccaaccagaccgaggacgggggacugccucagucaggccgcauuguuguggauuauaugguacagaagaguggcaaaacagggacuaucaccuaccaaagaggaauccugcucccacagaagguguggugcgcgagcgguaggucuaaagucauuaagggcuccuuaccccugauaggggaagcagacugucuucaugagaaauauggaggcuugaacaagucaaagagcuacuacacaggugagcacgccaaagcuaucgggaauugcccgauuugggugaagacuccucugaaacuagccaacggcaccaaguaucggcccccagcacaucucaguuacuuuuguggauucuuuggcgcuaucgccggguuccuggaaggagguugggagggcaugauagcgggguggaauggauauacaucucacggcgcccacgguguugcaguggucgcugaucuuaaauccacccaggaagccauuaacaagaucacuaagaaucugaacagcuugucggagcucgaagugaaaaaucugcagcgcuuaucuggggcuauggacgagcugcauaacgagauccucgaacuugaugagaagguagacgaccugcgagccgauacgauuuccucacaaaucgaauuggcaguucuacugaguaaugagggcauuauaaacagcgaagacgagcaccuccuggcccuugagagaaaacugaagaaaauguugggaccuuccgcuguggaaaucggcaaugggugcuuugagacaaagcauaagugcaaccagaccugucucgauaggauugcggcaggaacuuucgacgccggugaauuuucucugcccaccuucgauagcuuaaauaucacagcugccucacugaacgacgauggccuagacaaucacaccauccuccuguacuauaguacugcagccuccagccuugcugucacauugaugauugccauauucguggucuacauggugucucgggauaacguuucaugcaguaucugucuguga

SEQ ID NO: 148608 - RNA, 1758 nt, Artificial Sequence
  derived and/or modified sequence opt3 from hemagglutinin__InfluenzaB__AEA51399
augaaggccaucauugugcugcucauggucguuaccagcaacgcugacagaauaugcacaggcaucacugcaucccagucucccaauauugauaaaucaaguacgcaaggggaggugaacguaaccggagugaucccucuuacaacuaccccaacaaagagccacuucgccaaucugaaagguaccgaaacuaggggcaaguuguguccgaaaugccccaacuguacagacuuagaugucgcgcuggggcggccuaagugcaccggaaagauuccauccgcucgcgugucuauccuacaugagguucgacccgugacgucgggcuguuuuccuauaaugcacgaccguacuaaaaucagacagcucccaaaucugcuuagggguuacgaacauauucggcugucaacccacaacgucaucaaugccgagaacgcacccgggggaccuuauaagauuggcacaagcggcaguugcccaaaugugacuaacgggaucggauucuuugccaccauggcuugggcaguaccgaaaaaugauaagaacaaaacagccaccaaucccuugacgauagaaguuccuuacauuuguacugagggugaggaccagaucacaguguggggcuuccauuccgauaacgaaacccagauggcuaagcucuauggggacucuaagccacaaaaauuuacuagcuccgccaauggagucacaacccacuacgugucacagauuggcgguuuccccaaccagacggaggaugggggacugccucagaguggccgcaucguggucgacuauaugguucaaaagagcggcaaaaccgggacaaucacuuaccagagagguauucugcucccacagaagguguggugcgcgucuggaagguccaaaguaauaaagggcucauuaccccugaucggggaagcagauugucuucacgagaaauauggaggcuugaacaagagcaagaguuacuacaccggugagcaugccaaagcuauugggaauugcccgaucugggugaagacaccucugaaacuagccaacggcacuaaguaucggcccccagcacaccucucuuacuuuuguggauucuuuggcgcuauagccggguuccuggaaggagguugggagggcaugauugcgggguggaauggauauaccucccauggcgcccacggugucgcagugguugcugaccuuaaaagcacacaggaagccaucaacaagaucaccaagaaucugaacucguugucugagcucgaagugaaaaaucugcaacgcuuauccggggcuauggaugagcugcacaacgagauucucgaacuugacgagaaggucgacgaucugcgagccgacacuaucucaagucagauugaauuggcagugcuacugagcaaugagggcauaaucaacuccgaagaugagcaucuccuggcccuugagagaaaacugaagaaaauguugggaccuucugcuguagaaauuggcaaugggugcuuugagacgaagcacaagugcaaccagacaugucucgacaggaucgcggcaggaaccuucgaugccggugaauuuagccugcccacuuucgacucauuaaauaucaccgcugccagucugaacgaugacggccuagauaaucauacaauucuccuguacuauuccaccgcagccagcucucuugcuguuacuuugaugauagccaucuucguggucuacauggugucacgggacaacgucaguugcagcauuugucuguga

SEQ ID NO: 148609 - RNA, 1758 nt, Artificial Sequence
  derived and/or modified sequence opt3 from hemagglutinin__InfluenzaB__AEG21014
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuacacuguaccgaucuggacguugcgcuagggcggcccaagugcacgggaaagaucccuagcgcucgcguguccauucuccaugagguccgaccagugacuucuggcuguuuucccaucaugcacgaucguaccaaaauaagacaacugccuaaccuucugagggguuacgaacauauccgguugucgacacacaauguaauuaacgccgagaaugcaccagggggacccuauaagaucggcacuucaggcagcugcccuaacguuaccaaugggaacggauucuuugccacaauggcuugggcagugccgaaaaaugacaacaauaagaccgccacgaacagucucacuauugaagucccauacaucuguacagagggugaggaucagauaaccguguggggcuuccacuccgacaaugaaacucagauggcuaaacuguauggggauucuaagccccagaaguuuacaagcuccgccaacggagugaccacgcauuacgucucacaaaugggcgguuucccuaaccagaccgaggacgggggacugccacagaguggccgcauuguuguggauuauaugguacagaaaagcggcaagacagggacuaucaccuaccaaagagguauucucuuaccccagaaaguguggugcgcgucuggaagguccaaggucaucaaaggcucacugccucuuaucggggaagcagacuguuugcacgagaaguauggaggccugaauaaaagcaagccauacuacacaggugagcaugccaaggcuauugggaacugccccauaugggugaaaacuccgcuaaagcucgccaauggcaccaaauaucggccucccgcaaagcugcuuauggaacgcggauuuuucggcgcuaucgccggguuucuggagggagguugggaaggcaugauugcgggguggcacggauacacaagucacggcgcccaugguguugcaguggcugccgauuugaaaucuacccaggaggcuaucaacaagauaacuaagaaucucaacucccugagcgaauuagaggucaaaaaucugcagcgacucucgggggccauggacgagcuucacaacgaaauucuggaguuggaugaaaagguggacgaccuaagagcagauacgaucucuucccaaaucgagcuggccguacuccugucaaaugaaggcauuaucaacagugaggacgagcaucuucuggcuuuggaaaggaaacucaagaaaaugcugggaccaagcgcgguugagauuggcaauggguguuucgaaacaaagcacaagugcaaccagaccugcuuagaucggauagcagccggaacuuuugacgcuggugaguucucccugccuaccuuugauucucuaaauaucacagccgcaagccucaacgacgauggccuggacaaucauaccauucuuuuguauuacucaacugccgcuaguucccuggccgugacacucaugaucgcaaucuucgucguguauauggucagccgugauaacgugucuuguucaauuugccuguga

SEQ ID NO: 148610 - RNA, 1755 nt, Artificial Sequence
  derived and/or modified sequence opt3 from hemagglutinin__InfluenzaB__AEG21015
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaaauggguucuuugcaaccauggccugggcuguuccaaaggacaacuauaaaggagccacgaauccgaagacuguggagguccccuacauuuguacagaaggugagggccagaucaccguguggggguuccauuccgauaacaaaccucagaugaagaaucuguauggagacucuaacccacaaaaguuuacuagcuccgcgucaggcgugacaacccacuacgucagucagauuggugauuuccccgaccagacggaggaugggggacugccucagagcggcagaaucguuguggacuauaugaugcaaaaaccaggcaagaccgggacaauaguauaccagaggggagugcucuuaccccagaaagucuggugcgcaucuggucgguccaaggugauuaaaggcucacugccgcuuaucggggaagccgauuguuugcaugagaaguacggaggccugaauaaaagcaagccuuauuacacuggugaacacgcuaaggccauugggaacugccccaucuggguuaucaccccacagaaacuagcaaacggcacaacuuuuaguccucccgcuaagcuccugaaagagcgcggauucuuuggcgccauugcgggguuccuugagggagguugggaaggcaugauagccggguggcacggauauaccucucauggcgcacacgguguggcugucgccgcugaccugaaguccacacaagaggccaucaauaaaauuaccaagaacuugaauagccucucggaacuggaggugaagaacuuacagcgacugucuggggcaauggacgaacuccauaaugagauccuugagcuggaugaaaaaguagacgauuugagagccgacacuauauccucacagauugagcuagcuguucugcucaguaacgaaggcaucaucaauagcgaggaugaacaucugcuugcgcuggagaggaaguugaaaaagaugcucggaccauccgcaguggacauuggcaacggguguuuugagacgaaacacaagugcaaucaaacaugccuggaucggaucgccgcuggaaccuucaacgccggugaauuuucuuuacccacuuucgacagccugaauauuaccgcagccucacuaaacgaugacggccucgauaaucacacaauacugcuuuacuauaguaccgcugccuccagcuuggcagucacucugaugcucgcgaucuucauuguguacauggucucucgugacaacgugucauguaguaucugccuguga

SEQ ID NO: 148611 - RNA, 1755 nt, Artificial Sequence
  derived and/or modified sequence opt3 from hemagglutinin__InfluenzaB__AEG21016
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaagagccacgaacccgaagacuguggagguccccuacaucuguacagaaggagaggaucagauuaccgugugggguuuccauuccgacaauaaaccucagaugaagaacccauauggcgauucuaauccccaaaaguuuacuagcuccgcgucaggggugacaacccacuacgucagucagaucggagacuucccugaucagacggaggacggcggucugccacagagcgggaggauaguuguggauuauaugaugcaaaaacccggaaagaccggcacaauuguauaccagcggggcgugcugcucccgcagaaagucuggugcgcaucugggcgcuccaaggugaucaaaggaucauuaccucugauuggugaagccgacugucuucaugagaaguacggcggguugaacaaaagcaagcccuauuacacuggagaacacgcuaaggccaucggcaauugcccaaucuggguuaaaaccccucugaagcuagcaaacgguacaaaauaucgacccccagcuaagcuccugaaagagagaggguuuuucggcgccauugcgggauuucuugagggcgggugggaaggaaugauagccgguuggcacggcuacacaagucauggggcacacggaguggcugucgccgcugaccugaagucuacccaggaggccaucaacaagauuacuaaaaauuugaacucccucagcgaacuggaggugaagaauuuacaaaggcugucgggcgcaauggaugaacuccauaacgagauccuugagcuggacgaaaaaguagaugacuugcgggccgauaccauaucuucccagauugagcuagcuguucugcucucaaaugaagguaucaucaacagugaggacgaacaucugcuugcgcuggagcguaaguugaaaaagaugcucgggcccagcgcaguggauauuggcaauggauguuucgagacuaagcacaaaugcaaccagacgugccuggaccgcaucgccgcuggcacauuuaaugccggggaguucuccuuaccuaccuuugauucucugaacauuacugcagccagccuaaaugacgauggacucgacaaccacaccauacugcuuuauuacucaacagcugccaguuccuuggcagucacccugaugcucgcgaucuucauuguguauauggucagcagagacaaugugucuuguucaaucugccuguga

SEQ ID NO: 148612 - RNA, 1755 nt, Artificial Sequence
  derived and/or modified sequence opt3 from hemagglutinin__InfluenzaB__AEG21017
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccgagcuauaccggagaacacgcuaaggccaucggcaacugcccuaucuggguuaagacaccccucaaacuggcaaaugguacuaaguaccgcccuccagcuaaacuucugaaggagcgaggguuuuucggcgccauugcgggauuuuuggagggcgggugggaaggaaugauagccgguuggcacggcuauaccagucauggggcacacggaguggcugucgccgcugaccucaaaucuacacaggaggccaucaacaagauuaccaagaaucugaacuccuuaagcgaacuggaggugaaaaaucuccaaagacuuucgggcgcaauggaugaacugcauaacgagaucuuggagcuagacgaaaagguagaugaccugagggccgauacuauaucuucccagauugagcucgcuguucugcuuucaaaugaagguaucaucaacagugaggacgaacaccuguuggcgcucgagcggaaacugaagaaaauguuagggcccagcgcaguggauauuggcaauggauguuucgagacgaagcacaagugcaaccagacaugccuggaccguaucgccgcuggcaccuuuaaugccggggaguucucccuaccaacuuuugauucucucaacauuaccgcagccagccugaaugacgauggacuugacaaccauacaauauugcuguacuauucaaccgcugccaguucccucgcagucacucugaugcuugcgaucuucauuguguacauggucagccgcgacaaugugucuuguucaaucugccuguga

SEQ ID NO: 148613 - RNA, 1755 nt, Artificial Sequence
  derived and/or modified sequence opt3 from hemagglutinin__InfluenzaB__AEG21018
augaaggccaucauugugcugcucauggucguuaccagcaacgcugacagaauaugcacaggcaucacuuccucuauuucaccccuuguggauaaaacggcaacccagggggagguaaaugugacaggagucaucccucugacuaccacaccaaccaagaguuacuucgccaacgugaaagguacuaggacacggggcaaguuguguccggacugcuuaaauuguaccgaucuggacguugcgcuagggcgccccaugugcgugggaacgacuccuagcgcuaaagccuccauucuccacgaaguccgaccagugaccucuggcuguuuucccaucaugcaugaucguacaaagauaagacaacugccuaaccuucugagggguuaugagaauauccgguugucgacucagaacguaauugacgcacagaaggccccagggggacccuaccgccucggcaccucaggcagcugcccuaaugcuacaaguaaaaucggguucuuugcaaccauggccugugcuguuccaaaggauaacuauaaaaaugccacgaacccgcugacuguggaaguccccuacauuagaacagagggagaagaccagaucaccgugugggguuuccacuccgauaauaagacucaaaugaaaaaccuguauggcgacucuaauccuccaaaguuuacaagcuccgcgaacggggugaccacgcauuacgucucacagaccggagauuuccccgaccagacagaggauggcggucucccuccaagugggaggauaguuguggacuauaugaugcagaagcccggaaaaacuggcccgauugcauaccaacggggcguauuacugccucagaagguguggugcgccagcgggcgcucuaaagucaucaagggaucccuucccuugauuggugaggcugacugucugcacgaaaaauacggcgggcuaaauaagucaaaauauagccauaccggagaucacgccaagacacucggcaacugcccaaucugggugaagacuccucugaaacuugcaaacgguaccaaguaccgacccagugcuaaacuguugaaggagagaggguuuuucggcgccaucgcgggauuucucgaaggcgggugggagggaaugauugccgguuggcacggcuauacaucucauggggcacacggaguugcuguggccgcugaccugaaauccacccaggaggccauaaauaagaucacuaagaacuuaaauagccugucggaacucgaggucaaaaaccuucagaggcugucuggcgcaauggaugaauugcauaaugagauucuagaacuggacgagaagguggaugaccuccgggccgauacgaucuccucacaaauagagcuggcuguacuucugaguaacgaagguauuaucaauagcgaggacgaacacuugcucgcgcuggagcguaaauuaaagaaaaugcuggggccauccgcaguugauaucggcaacggauguuucgaaacaaagcacaagugcaaucagaccugccuagaccgcauugccgcuggcacuuuuaacgccggggaguucucucuccccaccuuugauagccugaauaucacagcagccucacuuaacgacgacggauuggauaaucauaccauucugcucuacuauaguacugcugccuccagccuggcagugacacuuaugcuggcgauauucaucgucuacauggugucuagagacaacgucucauguaguauuugcuuguga

SEQ ID NO: 148614 - RNA, 1755 nt, Artificial Sequence
  derived and/or modified sequence opt3 from hemagglutinin__InfluenzaB__AEG21019
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaccggagacuucccagaucagacagaggacggcgguuuacccccuagugggagaaucguuguggauuauaugaugcagaagccaggaaaaacuggcaccauaguauaccaaaggggcgugcuccugccccagaaggucuggugcgcaagcgggcggucuaaagugauuaagggaucccuuccguugaucggugaagccgacugucugcaugagaaauacggcgggcuaaacaagucaaaaccuagcuauacaggagaacacgcuaaggccauuggcaacugccccaucuggguuaagacuccacucaaacuggcaaaugguaccaaguaccgcccuagugcuaaacuucugaaggagcgaggguuuuucggcgccaucgcgggauuuuuggagggcgggugggaaggaaugauugccgguuggcacggcuauacaucucauggggcacacggaguggcugucgccgcugaccucaaauccacccaggaggccauaaacaagaucacuaagaaucugaacagcuuaucggaacuggaggugaaaaaucuccagagacuuucuggcgcaauggaugaacugcauaacgagauuuuggagcuagacgaaaagguagaugaccugagggccgauacgaucuccucacaaauagagcucgcuguucugcuuaguaaugaagguauuaucaacagcgaggacgaacaccuguuggcgcucgagcggaaacugaagaaaauguuagggcccuccgcaguggauaucggcaauggauguuucgagacaaagcacaagugcaaccagaccugccuggaccguauugccgcuggcacuuuuaaugccggggaguucucucuaccaaccuuugauagccucaacaucacagcagccucacugaaugacgauggacuugacaaccauaccauuuugcuguacuauaguacugcugccuccagccucgcagucacacugaugcuugcgauauucaucguguacauggucucucgcgacaaugugucauguaguauuugccuguga

SEQ ID NO: 148615 - RNA, 1758 nt, Artificial Sequence
  derived and/or modified sequence opt3 from hemagglutinin__InfluenzaB__AEG21021
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccauccugcaugaucguaccaaaauaagacaacuuccuaaucuguugagggguuacgaacacauccggcucucgacacauaacguaauuaaugccgagaacgcaccagggggacccuauaagaucggcacuucaggcagcugcccuaauauuaccaacgggaauggauucuuugccacaauggcuugggcaguuccaaagaacgacaagaauaaaaccgccacgaacccgcugaguaucgaagugcccuacauauguacugagggugaggaucagauuacagucuggggcuuccacuccgacaaugaaacccagauggcuaagcuguauggggauucuaagccucagaaauuuacuagcuccgccaacggaguggcgacacacuacgugucacaaaucggcgguuucccaaaccagaccgaggacgggggacucccccagaguggccgcauugucguugauuauauggugcagaaaagcggcaaaacggggaccaucacauaccaaagaggaaucuuacugccucagaagguauggugcgcaucugguagguccaaagugauuaagggcucacuuccauuguuuggggaagccgacugucugcaugagaaauauggaggcuucaauaagagcaagcccuacuacacuggugagcacgcuaaagccauagggaacugcccgaucugggucaagaccccucuaaaacucgcaaauggcacaaaguaucggcccccagcuaaacuguuuaaggaacgcggauucuuuggcgccauugcgggguuccuugagggagguugggaaggcaugaucgccggguggcauggauacaccagucacggcgcacacgguguggcuguugccgcugaucugaagucuacucaggaggccauaaacaaaauuacaaagaauuugaacucccucagcgaacuggaggugaaaaauuuacagcgacugucgggggcaauggacgagcuccauaacgaaauccuugagcuggaugaaaaggucgacgacuugagagccgauaccaucucuucccaaauugagcuagcugugcugcucucaaaugaaggcaucauuaacagugaggacgagcaucugcuugcgcuggaaaggaaauugaagaagaugcucggaccuagcgcaguagagauaggcaauggguguuuugaaacuaaacacaagugcaaccagacgugccuggaucggaucgccgcuggaacauucgacgccggugaguucuccuuacccaccuuugauucucugaauauuacugcagccagccuaaacgacgauggccucgacaaucacaccauccugcuuuauuacucaacagcugccaguuccuuggcaguuacccugaugaucgcgauuuucguggucuauauggugagccgugauaacgucucuuguucaauaugccucuga

SEQ ID NO: 148616 - RNA, 1758 nt, Artificial Sequence
  derived and/or modified sequence opt3 from hemagglutinin__InfluenzaB__AEG21022
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaacuaccccuagcgcucgcgccuccauccuccacgaggugcgaccagucacaucuggcuguuuucccauucugcaugaucguacuaagaucagacaacuuccuaaucuguugagggguuacgaacacauacggcucucgacccauaacgugaucaaugcagagaacgccccagggggacccuauaaaauuggcacaucaggcagcugcccuaauaucaccaacgggaauggauucuuugcuacgauggcaugggccguaccaaagaacgacaaaaauaagacugcuacaaacccgcugaguguugaagugcccuacauuuguaccgagggugaggaucagaucacugucuggggcuuccacuccgacaaugaaacacagauggccaaacuguauggggauucuaagccucagaaguuuaccagcuccgcgaacggaguggcaacgcacuacgugucacaaauaggcgguuucccaaaccagaccgaggacgggggacucccccagaguggccgcauugucguugauuauauggugcagaaaagcggcaagacagggacuaucaccuaccaaagaggaauuuuacugccucagagggguuggugcgccucuggccgguccaaaguaaucaaggggucacuuccauuguuuggagaagcugacugucugcaugagaaauauggcggucuaaauaagagcaaacccuacuacacaggggagcacgccaaggcaaucggcaacugcccgauuugggugaagacuccucucaaacuggcuaauggaaccaaguaucgacccccagccaaacuuuucaaggaacgcggcuuuuucggggcgauagccggauuucuggaggguggcugggaagggaugaucgcaggauggcauggcuacacaagucacggugcucacggggucccuguggccgcugauuugaaaucuacccaggaggccauuaacaagaucacuaagaaucucaacucccugagcgaauuagagguuaaaaaucugcagagacucucgggcgcaauggacgagcuucauaacgaaauacuggaguuggaugaaaagguggacgaccuaagggccgauacgauuucuucccaaaucgagcuggcuguccuccugucaaaugaaggaaucauuaacagugaggacgagcaccuucuggcguuggaacggaaacucaagaaaaugcugggccccagcgcaguggagaucgggaauggauguuucgaaacaaagcauaagugcaaccagaccugcuuagaucguauugccgcugguacuuuugacgccggcgaguucucccugccaaccuucgauucucuaaauauaacagcagccagccucaacgacgaugggcuggacaaucacaccauccuuuuguauuacucaacugcugccaguucccuggcaguaacacucaugauugcgaucuuuguuguguauauggucagccgcgauaacgugucuuguucaaucugccuguga

SEQ ID NO: 148617 - RNA, 1755 nt, Artificial Sequence
  derived and/or modified sequence opt3 from hemagglutinin__InfluenzaB__AEG21023
augaaggccaucauugugcugcucauggucguuaccagcaacgcugacagaauaugcacaggcaucacuuccucuaauucaccccacgugguaaaaacggcaacccuuggggaagugaacgaaacaggagucauuccucugacuaccacaccaaccaagaguuacuucgccaauuugaaagguacuaggacacggggcaaguuauguccggauugccugaacuguaccgaccuagauguggcgcucgggcgccccaugugcguuggaacgacuccuagcgcuaaagccuccauccugcaugaggugcgaccagucaccucuggcuguuuucccauuaugcacgaccguacaaagaucagacagcuuccuaaucuguugagggguuaugaaaacauacggcucucgacucaaaaugugaucgaugcagagaaggccccagggggacccuaccgccugggcaccucaggcagcugcccuaacgcuacaaguaaaauuggguucuuugcaaccauggccugggcuguaccaaaggacaauuauaaaaacgccacgaauccgcugacuguugaagugcccuacaucuguacagagggagaggaucagauuaccgucugggguuuccauuccgacaacaagacucagaugaaaaaucucuauggcgauucuaacccucagaaguuuacaagcuccgcgaauggggugccaacccacuacgugucacaaaucggagacuuccccgauccuacggaagacggcgguuuaccacagagugggagaauaggagucgauuauaugaugcagaagcccggcaaaaccggcacaauuguuuaccagcgcggggugcugcuuccgcaaaagguauggugcgcaagcggacggucuaaagugaucaaggguuccuugccucugauuggcgaggccgacugucuacaugaaaaauacgggggacucaacaagucaaaacccuauuacacuggcgagcacgcuaaggccaucgguaacugcccaaucugggucaagaccccucugaaacuugcaaaugggacaaaguauaggcccccagcuaaacuguugaaggagcgaggcuuuuucggagccauuagcggcuuucucgaagggggaugggaggguaugauagcgggcuggcacggguacaccagucauggagcccacggcguggcaguugcugccgaccugaaaucuacucaggaagcuaucaacaagauuacaaagaauuuaaacucccugagcgagcucgaagugaaaaaucuucagagacugucgggugccauggaugaguugcauaacgagauccuagaacuggacgagaaggucgaugaccucagggcagauaccauaucuucccagauugaacuggccgugcuucugucaaaugaggggaucaucaacagugaagacgagcacuugcucgcucuggagcggaaauuaaagaaaaugcugggccccagcgcgguagaaauuggaaauggcuguuucgagacuaagcacaagugcaaccaaacgugcuccgaucguaucgcagccgggacauuugacgcuggagaguucucucuaccuaccuuugauagccucaauauuacugccgcaucacugaacgacgauggucuugacaaucauaccauauugcuguauuacaguacagccgcuuccagccucgccguuacccugaugaucgcaauuuucguggucuauauggugucucgcgacaacgucucauguaguaucugccuuuga

SEQ ID NO: 148618 - RNA, 1758 nt, Artificial Sequence
  derived and/or modified sequence opt3 from hemagglutinin__InfluenzaB__AEG21024
augaaggccaucauugugcugcucauggucguuaccagcaacgcugacagaauaugcacaggcaucacuuccucuucaaguccccacgugguaaaaacggcaacccagggggaggugaaugucacaggagugauuccucuuacuaccacaccaaccaagagcuacuucgccaaccugaaagguacugaaacaaggggcaaguuguguccggauugccccaauuguaccgacuuagauguugcgcuggggcggccuaacugcuggggaaauaucccauccgcucgcgugucuauucuacaugagguccgacccgugacgucgggcuguuuuccuaucaugcacgaccguacuaaaauaagacaacucccaaaccugcuuagggguuaugaacauauccggcugucaacccacaauguaauuaacgccgagaaugcacccgggggaccuuacaagaucggcacaagcggcaguugcccaaacguuacuaaugggaacggauucuuugccaccauggcuugggcagugccgaaggaugacaaaaauaacgccgcuacacauuugcucaccauugaaguccccuucuuuuguacggguggcgagcaccacaucgccguguggggguucccuuccgauaaugacacucugauggcgaagcuguuuggagauucuaacccacagauguucagcuccucagcaaacggcacaaccacucauuaugugagucagauagguggguuucccaaucagacagaggacggaggccucccucaaagcggccgcauugucguugauuacauggugcagaaaucugggaagaccggaacgaucgccuaucagagagguguauuacugccacagaaaguguggugcgcuuccggcaggucaaaggucauuaaggggagccuucccuugaucggagaagccgacugucugcacgagaaauacggcggucuaaacaagaguaaaccguauuacaccggggaacaugcaaaggcuaucggcaauugcccuauuugggugaaaacaccccucaagcuggccaacggaacuaaauaccggccuccagcgaaacuucugaaggagcgcggcuucuuuggggccauagcaggauucuuggaggguggcugggaagggaugaucgcuggauggcacggcuauaccucucacggugcccaugggguugcuguggccgcagaucucaaguccacacaagaggccauuaauaagaucacuaaaaaccugaauagcuuaucggaacuggaggucaagaaccuccagcgacuuucuggcgcuauggacgaacugcacaaugagauauuggagcuagacgaaaaaguggaugaccugagagcggauaccauuuccucacagaucgagcucgcaguacugcuuaguaacgaaggaaucauuaauagcgaggacgaacaucuguuggcccucgagaggaagcugaagaaaauguuaggccccuccgcuguugagaucgggaacggauguuuugaaacaaagcacaaaugcaaucagaccugccuggaucggauugccgcagguacuuucgacgccggcgaguucucucuaccaacguuugauagccucaacauaacagcugccucacugaaugacgaugggcuugacaaccauaccaucuugcuguacuauaguacugcagcguccagccucgcugugacccugaugauugccaucuucgucguguacauggucucucgugauaacgugucauguaguaucugccuuuga

SEQ ID NO: 148619 - RNA, 1755 nt, Artificial Sequence
  derived and/or modified sequence opt3 from hemagglutinin__InfluenzaB__AEG21025
augaaggccaucauugugcugcucauggucguuaccagcaacgcugacagaauaugcacaggcaucacuuccucuaauucaccccacgugguaaaaacggcaacccuuggggaagugaacgaaacaggagucauuccucugacuaccacaccaaccaagaguuacuucgccaauuugaaagguacuaggacacggggcaaguuauguccggauugccugaacuguaccgaccuagauguggcgcucgggcgccccaugugcguuggaacgacuccuagcgcuaaagccuccauccugcaugaggugcgaccagucaccucuggcuguuuucccauuaugcacgaccguacaaagaucagacagcuuccuaaucuguugagggguuaugaaaacauacggcucucgacucaaaaugugaucgaugcagagaaggccccagggggacccuaccgccugggcaccucaggcagcugcccuaacgcuacaaguaaaauuggguucuuugcaaccauggccugggcuguaccaaaggacaauuauaaaaacgccacgaauccgcugacuguugaagugcccuacaucuguacagagggagaggaucagauuaccgucugggguuuccauuccgacaucaagacucagaugaaaaaccucuauggcgauucuaauccucagaaguuuacaagcuccgcgaacggggugccaacccacuacgugucacaaauaggagacuuccccgauccuacggaagacggcgguuuaccacagagugggagaauuggagucgauuauaugaugcagaagcccggcaaaaccggcacaaucguuuaccagcgcggggugcugcuuccgcaaaagguauggugcgcaagcggacggucuaaagugauuaaggguuccuugccucugaucggcgaggccgacugucuacaugaaaaauacgggggacucaauaagucaaaacccuauuacacuggcgagcacgcuaaggccaucgguaacugcccaauuugggucaagaccccucugaaacuugcaaacgggacaaaguauaggcccccagcuaaacuguugaaggagcgaggcuuuuucggagccauaagcggcuuucucgaagggggaugggaggguaugaucgcgggcuggcacggguacaccagucauggagcccacggcguggcaguugcugccgaccugaaaucuacucaggaagcuauuaauaagaucacaaagaacuuaaauucccugagcgagcucgaagugaaaaaccuucagagacugucgggugccauggaugaguugcauaaugagauacuagaacuggacgagaaggucgaugaccucagggcagauaccauuucuucccagaucgaacuggccgugcuucugucaaacgaggggaucauuaauagugaagacgagcacuugcucgcucuggagcggaaauuaaagaaaaugcugggccccagcgcgguagaaaucggaaacggcuguuucgagacuaagcacaagugcaaucaaacgugcuccgaucguauugcagccgggacauuugacgcuggagaguucucucuaccuaccuuugauagccucaacauaacugccgcaucacugaaugacgauggucuugacaaccauaccaucuugcuguauuacaguacagccgcuuccagccucgccguuacccugaugauugcaaucuucguggucuauauggugucucgcgacaaugucucauguaguaucugccuuuga

SEQ ID NO: 148620 - RNA, 1758 nt, Artificial Sequence
  derived and/or modified sequence opt3 from hemagglutinin__InfluenzaB__AEG21026
augaaggccaugauggugcugcucauggucguuaccagcaacgcugacagaaucugcacaggcauuacuuccucuaauucaccccacgugguaaaaacggcaacccagggggaggugaacgucacaggagugauaccucuuacuaucaccccaacaaagagucauuucgccaaucugaaaguuaaggaaaccagggguaaauuguguccgaagugccccaacuguacugauuuagacguggcgcugggccggccuaagugcacagggaaaauuccaagcgcucgcgucuccauccuacacgaggauacccccgugacgucuggauguauuccuaucaugcaugaccgaacuaagauacgucaacucccaaaucugcuuagaggcuacgaacacaucaggcugucgacccauaacguaauuaaugccgagucagcacccggugggccuuauaaaaucggaacaagcggcaguugcccaaacguuacuaauggcauuggguuuuucgccaccauggcuugggcagugccgaagaacgauaaaaauaagacagccaccaaccccuugacgaucgaagucccuuacauauguacugagggagaggaccagauuacagugugggguuuucacuucgauaaugaaacccagauggcuaagcucuauggcgacuccaaaccacagguguuuacuucuagcgccaacggggucaaugcggauuucguuucccaaauccggggauuucccaaccagacagaggacggcggucugccucagucagggcgcauugugguagauuacauggugcagaagaguggaaaaaccggcacgaucaccuaucaaagaggcauccugcucccacagaaggucuggugcgcaagcgggaggucuaaagugauuaaggaauccuuaccccugauaggagaggccuacuuccagcaggaggaauaugguggccuuaacaaaucaaagagcuacuacacagaggaacacgcuaaggccaucgggauuuguccgaucuggguuaaaacuccuuugaagcuggcaaauaaaaccaaguaucggcccccagcucaucuaaguuacuuuugcggauucuuuggcgccauagcggguuuccucgaagggggcugggagggaaugauugccggcuggaacggguauacaucucacggagcacaugguguggcugucguggccgaccugaaauccacucaagaggcuaucaauaagaucaccaagaaccuuaauagccugucggaguuggaaguagagacacuccagcgccugucuggcgccauggaugaauuacacaacgagauucuggaacucgacgagaaaguugacgaucaccgagcagacaccaucuccucacagauugagcuuccugaucaacugaguaaugacgggagcauaaacuccgaagaugagcauuugcuagcccuggaaagaaagcucaaaaagaugcugggacccucuaauggcgacaaagguagcgggggcaucgagacuaagcacaaguguaaccagacgugccuugauaggauugcugcgggaacauuugacgcaggcggguucucacauccaaccuucgauaguaaaaaugugacugccgcuucccugaacgacgauggauuggacagcgguaccauccuccuguacuauucuacagacgucucaaauuuagccgugaccgucaugaugggcaucuuugugaaguacaugguuagucgggauaacgugagcugcuccauuugucuguga

SEQ ID NO: 148621 - RNA, 1758 nt, Artificial Sequence
  derived and/or modified sequence opt3 from hemagglutinin__InfluenzaB__AEG21027
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaucaccccaacaaagagucauuucgccaaucugaaagguaccgaaacuaggggcaaguuguguccgaaaugccccaacuguacagauuuagacguugcgcuggggcggccuaagugcaccggaaagauuccaagcgcucgcguguccauccuacacgagguccgacccgugacgucuggcuguuuuccuauaaugcaugaucguacuaaaaucagacaacucccaaaucugcuuagggguuacgaacacauucggcugucgacccauaacguaaucaaugccgagaacgcacccgggggaccuuauaagauuggcacaucaggcagcugcccaaauguuacuaacgggaucggauucuuugccaccauggcuugggcagugccgaaaaaugacaagaacaaaacagccaccaaucccuugacgauagaagucccuuacauuuguacugagggugaggaucagaucacaguguggggcuuccacuuugacaacgaaacccagauggcuaagcucuauggggauaguaagccacagaaauucacuuccucugccaauggagugaacgcggacuuugucagccaaauuggcgguuuccccaaccagacagaggaugggggacugccucaguccggccgcaucguuguggacuacaugguacagaagucaggcaaaaccgggacgaucaccuaucaaagagguauucugcucccacagaagguguggugcgcaaguggaaggagcaaagucauaaaggaaucuuuaccccugaucggcgaggccuacuuucagcaggaggaauaugggggacuuaauaaauccaagucauacuacacaggcgagcacgcuaaggccauugguaacuguccgaucugggugaaaacuccuuugaagcuggcaaaugggaccaaauaucggcccccagcucaucuaagcuacuucugcggcuuuuucggagccauagcgggcuuucucgaagggggaugggaggguaugauugccggcuggaacggguauacaagucacggagcacauggcguugcuguggucgccgaucugaagucuacucaagaagcuaucaauaaaaucaccaagaaccuuaauucccugagcgaguuggagguggaaacacuccagcgccugucgggugccauggacgaguuacacaacgaaauucuggagaucgaugaaaagguagacgaccaccgagcagauaccauuucuucccagauagagcucgccguucuucugucaaaugaggggaucauuaacagugaagacgagcauuugcuagcucuggaaagaaaacucaagaaaaugcugggcccuagcaauggagauaagggcuccgggggaaucgagacuaaacacaaguguaaccaaacgugccuugacaggaucgcggcagguacauucgaugccggcgaguucucucugcccaccuuugacagcuugaauauuacugcugccucacucaacgaugacgggcuggauaguggaaccauauuacuguacuauuccacagacgugagcaaucuagcagucaccgugaugaugggcaucuucgucaaguacauggugucucgggauaacguuucaugcaguauuugucucuga

SEQ ID NO: 148622 - RNA, 1758 nt, Artificial Sequence
  derived and/or modified sequence opt3 from hemagglutinin__InfluenzaB__AEG21028
augaaggccaucauugugcugcucauggucguuaccagcaacgcugacagaauaugcacaggcaucacugcaucccagucucccaauauugauaaaucaaguacgcaaggggaggugaacguaagcugugugaucccucuuaccacaacuccaaccaagucccacuucgccaaucugaaagucaaggaaacaaggggaaaauugugcccgaagugucccaacugcaccgacuuagaugugucucugggucggccuaaguguacuggcaaaauuccaucggcgcgcguuucaauccuacaugaggugcgacccgucgcuagcgggggauuuccuauaaugcacgaccguacaaagaucagacagcucccaaaucugcuuaggggcuacgaacauauucggcugaguacccacaacgugaucaaugccgagaacgcacccggugggccuuauaaaauuggaacguccggcucuugcccaaauguaacuaacggcaucggguucuuugccaccauggcuugggcaguuccgaagaaugauaaaaacaagacagccacuaaucccuugaccauagaagugccuuacauuuguacagagggagaggaccagaucaccgucugggguuuccauagcgauaacgaaacgcagauggcuaagcucuauggcgacuccaaaccacaaaaguuuacuucaagugccaauggggugacaacccacuacgcggcaaaacgccccugcuucccuaaccagacugaggauggaggccugccacagagcgguagaauuguggucgacuauaugguucagaagucugggaaaacaggaaccaucacguaccaaaggggcauccugcucccccagaagguguggugugccuccggccggucaaaaguaauuaaggggagcuuaccgcugauaggagaagcugauugccuucacgagaaguaugguggcuugaacaaaaguaagucuuacuacaccggggagcaugccaaagcaaucggaaauuguccuauuugggugaagacaccccugaaacuagcuucccgcacuaugagcaagaccccagcccaccucucguauuuuugcggcuucuuuggugcgaucgccggguuccuggaaggcggaugggagggcaugauagcaggguggaacggauacacaucucauggugcucacggcgucgccgugguugcugaccuuaaguccacucaggaagccauuaauaaaaucaccaagaaccugaacucauugagugagcucgaagugaaaaaucugcagcgauuaagcggggcaauggaugagcugcacaaugagauccucgaacuugacgagaaggucgacgaucugagagccgacacaauuuccucucaaaucgaauuggcugugcuacugagcaacgagggaauuauaaauucagaagaugagcaucuccuggcgcuugagaggaaacugaagaagauguugggcccuagugcaguagaaaucgguaacgggugcuuugagaccaaacacaaguguaaucagacuugccucgaccggauugccgcuggcacguucgaugccggagaauuuucccugcccacauucgacagcuuaaacaucaccgcagccucucugaaugaugacggccuagauaaccauacuauccuccuguauuacucaaccgcugccaguagccuugcaguuacauugaugauugcgauauucguggucuauauggugucccgugacaaugucucuuguucgaucugccuguga

SEQ ID NO: 148623 - RNA, 1758 nt, Artificial Sequence
  derived and/or modified sequence opt3 from hemagglutinin__InfluenzaB__AEG21029
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggauuggauucuuugccacaauggcuugggcagugccgaaaaaugacaagaacaaaaccgccacgaaucccuugacuaucgaagucccuuacauauguacagagggugaggaucagauuaccguguggggcuuccacagugacuccgaaacucagauggcuaagcucuauggggauucuaagccacagaaauuuacaagcuccgccaacggagugaccacgcacuacgucucacaaaucggcgguuuccccaaucagaccgaggacgggggacugccucagaguggccgcauuguuguggauuauaugguacaaaagagcggcaaaacagggacuaucaccuaccagagaggaauccugcucccacagaagguguggugcgcgucugguagguccaaagucauuaagggcucauuaccccugauaggggaagcagacugucuucaugagaaauauggaggcuugaacaagagcaagccguacuacacaggugagcacgccaaagcuaucgggaacugcccuauuugggugaagacuccccugaaacuagccaauggcaccaaguaucggccuccagcaaaacuccugaaggaacgcggauuuuucggcgcuaucgccggguuucuugagggagguugggaaggcaugauagcgggguggcauggauacacaagucacggcgcccacgguguugcaguggcugccgaucugaagucuacccaggaggcuauuaacaaaaucacuaagaauuugaacucccucagcgaacuggaggucaaaaauuuacagcgacugucgggggccauggacgagcuccauaacgaaauccuugagcuggaugaaaagguggacgacuugagagcagauacgauuucuucccaaaucgagcuagccguacugcucucaaaugaaggcauuauaaacagugaggacgagcaucugcuugcucuggaaaggaaauugaagaagaugcucggacccagcgcgguugagaucggcaauggguguuucgaaacaaaacacaagugcaaccagaccugccuggaucggauugcagccggaacuuuugacgcuggugaguucuccuuaccaaccuuugauucucugaauaucacagccgcaagccuaaacgacgauggccucgacaaucacaccauccugcuuuauuacucaacugccgcuaguuccuuggccgugacacugaugauugcaauauucgucguguauauggucagccgugauaacgugucuuguucaaucugccucuga

SEQ ID NO: 148624 - RNA, 1758 nt, Artificial Sequence
  derived and/or modified sequence opt3 from hemagglutinin__InfluenzaB__AEO80052
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggaucggaucgcagccggaacuuuugacgcuggugaguucagcuuaccaaccuuugauucccugaauauuacagccgcaucucuaaacgacgauggccucgacaaucacaccauccugcuuuauuacagcacugccgcuucaaguuuggccgugacacugaugaucgcaauuuucgucguguauauggucucccgugauaacgugagcuguucuauaugccucuga

SEQ ID NO: 148625 - RNA, 1758 nt, Artificial Sequence; identical to SEQ ID NO: 148530
  derived and/or modified sequence opt3 from hemagglutinin__InfluenzaB__AEO80067

SEQ ID NO: 148626 - RNA, 1755 nt, Artificial Sequence
  derived and/or modified sequence opt3 from hemagglutinin__InfluenzaB__AEO80078
augaaggagaucauugugcugcucauggucguuaccagcaacgccgacagaauaugcacaggcaucacuuccucuaauucaccccacgugguaaaaacggcuacccagggggaagugaacgucacaggagugauuccucuuacuaccacaccaaccaagaguuacuucgcaaaucugaaagguacuaggacacggggcaaguuguguccggauugcuuaaacuguaccgaccuggauguugcccuagggcgccccaugugcgugggaacgacuccuagcgcgaaggcuuccauccuccaugagguccgaccagugaccucuggcuguuuucccauuaugcacgaccguacaaaaaucagacaacuggccaaucuucugagggguuaugaaaacauacgguugucgacucagaauguaaucgaugcagagaaggccccugggggaccauaccgccucggcaccucaggcagcugccccaacgcuacaaguaaauccggguucuuugcaaccauggccugggcuguuccuaaggacaauaacaaaaaugccacgaacccacugacuguggaagucccguauauuuguacagagggagaggaucagaucaccgugugggguuuccauucugacaauaagacucagaugaaaaaccuguacggcgauagcaauccccaaaaguuuacauccucagcgaacggggugaccacgcacuaugucagucagauuggaggcuucccugaccagaccgaagauggugggcucccacagagcggaagaaucguuguggacuacaugaugcaaaagcccggcaaaacaggcacuauaguauaucagcgcgggguguuacugccucagaaggucuggugcgcaucuggacgguccaaagugauuaaggguucacuuccauugaucggcgaggccgauugucugcaugaaaaauacgggggacuaaacaagagcaaacccuacuauaccggcgagcacgcuaaggccauugguaauugcccgaucuggguuaagacaccucucaaacuggcaaacgggacuaaguacaggcccccagcuaaacuucugaaggagcgaggcuuuuucggagccaucgcgggcuuuuuggaagggggaugggaggguaugauugccggcuggcacggguauaccagucauggagcacacggcguggcugucgccgcugaccucaaaucuacacaggaagccauaaauaagaucaccaagaacuuaaauucccugagcgagcuggaagugaaaaaccuccaaagacuuucgggugcaauggacgagcugcauaaugagauuuuggaacuagaugagaagguagacgaucugagggccgacacuaucucuucccagauagaacucgcuguucugcuuucaaacgaggggauuaucaauagugaagaugagcaccuguuggcgcucgagcggaaacugaagaaaauguuaggcccuagcgcaguggacaucggaaacggcuguuucgaaacgaagcacaagugcaaucagacaugccuggaucguauugccgcugggaccuuuaacgccggagaguucucccuacccacuuuugacucucucaauaucaccgcagccagccugaacgaugacggucuugauaaucauacaauuuugcuguacuauucaaccgcugccaguucccucgcagucacucugaugcuugcgauauucaucguguacauggucagccgcgacaacgugucuuguucaauuugccuguga

SEQ ID NO: 148627 - RNA, 1758 nt, Artificial Sequence
  derived and/or modified sequence opt3 from hemagglutinin__InfluenzaB__AEO80086
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccauuuggggcuuccacuccgacaacgagacucagauggcuaagcuguauggggauucuaaaccccagaaguuuacaagcuccgccaacggagugaccacgcacuacgugucacaaaucggcgguuucccuaaucagaccgaagacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcucacugccucuuauaggggaggcagacuguuugcaugaaaaguauggaggccugaacaagagcaaaccauacuacacaggugagcacgccaaggcuaucgggaauugccccauuugggucaaaacuccgcuaaagcucgccaacggcaccaaauauaggccucccgcaaagcugcuuaaggagcggggauuuuucggcgcuaucgccggguuucuggaaggagguugggagggcaugauagcgggguggcauggauacacaagucacggcgcccacgguguggcaguugcugccgauuugaaaucuacccaggaagcuauuaauaagaucacuaaaaaccucaauucccugagcgaguuagaagugaagaaccugcagcgccucucgggggccauggacgagcuucauaaugagauccuggaauuggaugagaaagucgacgaccuacgagcagauacgauuucuucccaaaucgaacuggccgugcuccugucaaacgagggcauuauaaauagugaagacgagcaccuucuggcuuuggagagaaagcucaagaaaaugcugggaccaagcgcgguagaaaucggcaacggguguuucgagacaaagcauaaaugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgggauaacgucucuuguucaaucugccuguga

SEQ ID NO: 148628 - RNA, 1755 nt, Artificial Sequence
  derived and/or modified sequence opt3 from hemagglutinin__InfluenzaB__AEO80097
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaggacacggggcaaguuguguccggauugcuuaaacuguaccgaccuggauguugcgcuagggcgccccaugugcgugggaacgacuccuagcgcuaaagccuccauccuccacgaaguccgaccagugaccucuggcuguuuucccauuaugcaugaccguacaaagaucagacaacuggcaaaucuucugagggguuacgagaacauacgguugucgacucagaauguaaucgaugccgaaaaggcuccugggggaccauaucgccucggcaccucaggcagcugccccaacgcaacaaguaaauccggguucuuugccaccauggcuugggccguuccuaaggacaauaacaaaaaugcgacgaacccacugacuguggaggucccguacauuuguacagaaggagaggaucagaucaccgugugggguuuccacucugacaauaagacucagaugaaaaaccuguauggcgauagcaauccccaaaaguuuacauccucagcaaacggggugaccacgcauuacgucagucagauuggaggcuucccugaccagaccgaggauggugggcucccacagagcggaagaaucguuguggacuauaugaugcaaaagcccggcaaaacaggcacuauaguauaccagcgcgggguguuacugccucagaaggucuggugcgccucuggacgguccaaagugauuaaggguucacuuccauugaucggcgaagcugauugucugcacgagaaauaugggggacuaaacaagagcaaacccuacuacaccggcgaacacgccaaggcaauugguaauugcccgaucuggguuaagacaccucucaaacuggcuaacgggacuaaguauaggcccccagccaaacuucugaaggagcgaggcuuuuucggagcgaucgccggcuuuuuggaagggggaugggaagguaugauugcaggcuggcauggguacaccagucacggagcucauggcguggccgucgcugccgaccucaaaucuacacaggaggcaauaaauaagaucaccaagaacuuaaauucccugagcgaacuggaggugaaaaaccuccaaagacuuucgggugccauggacgaacugcacaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccuagcgccguggacaucggaaacggcuguuucgagacgaagcauaagugcaaucagacaugccuggaucguauugcugccgggaccuuuaacgcaggagaguucucccuacccacuuuugacucucucaauaucaccgccgcuagccugaacgaugacggucuugauaaucacacaauuuugcuguauuacucaaccgccgcaaguucccucgcggucacucugaugcuugcuauauucaucguguauauggucagccgcgacaacgugucuuguucaauuugccuguga

SEQ ID NO: 148629 - RNA, 1755 nt, Artificial Sequence; identical to SEQ ID NO: 148442
  derived and/or modified sequence opt3 from hemagglutinin__InfluenzaB__AEO80108

SEQ ID NO: 148630 - RNA, 1758 nt, Artificial Sequence; identical to SEQ ID NO: 148530
  derived and/or modified sequence opt3 from hemagglutinin__InfluenzaB__AEO80145

SEQ ID NO: 148631 - RNA, 1758 nt, Artificial Sequence; identical to SEQ ID NO: 148589
  derived and/or modified sequence opt3 from hemagglutinin__InfluenzaB__AEO80154

SEQ ID NO: 148632 - RNA, 1758 nt, Artificial Sequence
  derived and/or modified sequence opt3 from hemagglutinin__InfluenzaB__AEO80183
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacauugaaacucagauggcuaagcuguauggggauucuaaaccccagaaguuuacaagcuccgccaacggagugaccacgcacuacgucucacaaaucggcgguuucccuaaucagaccgaggacgggggacugccacagaguggccgcauuguuguggauuauaugguacaaaagagcggcaaaacagggacuaucaccuaccagagaggaauccucuuaccccagaagguguggugcgcgucugguagguccaaagucauuaagggcucacugccucuuauaggggaagcagacuguuugcaugagaaauauggaggccugaacaagagcaaaccauacuacacaggugagcacgccaaggcuaucgggaauugccccauuugggugaagacuccgcuaaaacucgccaacggcaccaaguaucggccucccgcaaaacugcuuaaggaacgcggauuuuucggcgcuaucgccggguuucuggagggagguugggaaggcaugauagcgggguggcauggauacacaagucacggcgcccacgguguugcaguggcugccgauuugaaaucuacccaggaggcuauuaauaagaucacuaagaaccucaauucccugagcgaauuagaggucaaaaaccugcagcgacucucgggggccauggacgagcuucauaaugaaauccuggaguuggaugaaaagguggacgaccuaagagcagauacgauuucuucccaaaucgagcuggccguacuccugucaaacgaaggcauuauaaauagugaggacgagcaccuucuggcuuuggaaaggaaacucaagaaaaugcugggaccaagcgcgguugagaucggcaacggguguuucgaaacaaagcauaagugcaaucagaccugcuuagaucggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccgugacacucaugauugcaauauucgucguguauauggucagccgugauaacgugucuuguucaaucugccuguga

SEQ ID NO: 148633 - RNA, 1758 nt, Artificial Sequence
  derived and/or modified sequence opt3 from hemagglutinin__InfluenzaB__AEO80194
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaagcucagauggccaagcuguauggggauucuaaaccccagaaguuuacuagcuccgcgaauggagugacaacccacuacgucucacaaauuggcgguuucccuaaccagacggaggacgggggacugccacagaguggccgcaucguuguggauuauaugguacaaaagagcggcaaaaccgggacaauuacuuaccagagaggaauccucuuaccccagaagguguggugcgcaaggggucggucuaaagucaucaagggcucccugccucuuauuggggaagccgacuguuugcaugagaaauauggaggccugaauaagucaaaaccauacuacaccggugagcacgcuaaggccauagggaacugccccaucugggugaagacaccgcuaaaacucgcaaauggcacuaaguaucgcccucccgcuaaacugcuuaaggaacgaggauuuuucggcgccauugcgggguuucuggagggagguugggaaggcaugaucgccggguggcauggauacaccagccacggcgcacacgguguugcuguggccgcugauuugaaaaguacacaggaggccauaaacaagauuaccaagaaucucaacucucuguccgaauuagaggucaaaaaucugcagagacucagcggggcaauggacgagcuucauaacgaaauccuggaguuggaugaaaagguggacgaccuaagggccgauacuaucucgucucaaauugagcuggcuguacuccuguccaaugaaggcaucauuaacucagaggacgagcaccuucuggcguuggaacggaaacucaagaaaaugcugggaccaagugcaguugagauaggcaauggguguuucgaaacgaagcauaagugcaaccagacaugcuuagaucguaucgccgcuggaaccuuugacgccggugaguucagccugccuacuuuugauucccuaaauauuaccgcagccucucucaacgacgauggccuggacaaccacacaauccuuuuguauuacagcaccgcugccucaagucuggcagugacucucaugaucgcgauuuucgucguguauaugauaucccgcgauaaugucagcuguucuaucugccuguga

SEQ ID NO: 148634 - RNA, 1758 nt, Artificial Sequence; identical to SEQ ID NO: 148581
  derived and/or modified sequence opt3 from hemagglutinin__InfluenzaB__AEO80205

SEQ ID NO: 148635 - RNA, 1758 nt, Artificial Sequence; identical to SEQ ID NO: 148581
  derived and/or modified sequence opt3 from hemagglutinin__InfluenzaB__AEO80216

SEQ ID NO: 148636 - RNA, 1755 nt, Artificial Sequence
  derived and/or modified sequence opt3 from hemagglutinin__InfluenzaB__AEO80227
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagauucagaugaaaaaccuguacggcgauagcaauccccaaaaguuuacuuccucagcaaacggggugacaacccacuaugucagucagaucggaggcuucccugaccagacggaggauggugggcucccacagagcggaagaauaguuguggacuacaugaugcaaaagcccggcaaaaccggcacaauuguauaucagcgcgggguguuacugccucagaaggucuggugcgccucuggacgguccaaagugaucaaggguucacuuccauugauuggcgaagcugauugucugcaugagaaauacgggggacuaaacaagagcaaacccuacuauacuggcgaacacgccaaggcaaucgguaauugcccgaucuggguuaagaccccucucaaacuggcuaacgggacaaaguacaggcccccagccaaacuucugaaggagcgaggcuuuuucggagcgauugccggcuuuuuggaagggggaugggaagguaugauagcaggcuggcacggguauacuucccauggagcucacggcguggccgucgcugccgaccucaaaucuacccaggaggcaaucaauaagauuacaaagaaccugaauaguuuaagcgaacuggaggugaaaaaccuccaaagacuuucgggugccauggacgaacugcauaaugagaucuuggagcuagaugaaaagguagacgaucugagggcugacaccauaucuucccagauugagcucgcgguucugcuuucaaacgaagggaucaucaauagugaggaugaacaccuguuggcacucgagcggaaacugaagaaaauguuaggcccuagcgccguggacauuggaaacggcuguuucgagacuaagcacaagugcaaucagacgugccuggaucguaucgcugccgggacauuuaacgcaggagaguucucccuacccaccuuugacucucucaauauuacugccgcuagccugaacgaugacggucuugauaaucauaccauauugcuguacuauucaacagccgcaaguucccucgcggucacccugaugcuugcuaucuucauuguguacauggucagccgcgacaacgugucuuguucaaucugccuguga

SEQ ID NO: 148637 - RNA, 1758 nt, Artificial Sequence; identical to SEQ ID NO: 148598
  derived and/or modified sequence opt3 from hemagglutinin__InfluenzaB__AEO80238

SEQ ID NO: 148638 - RNA, 1758 nt, Artificial Sequence
  derived and/or modified sequence opt3 from hemagglutinin__InfluenzaB__AEP20178
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugcuuaaacuguaccgaucuggacguugcccuagggcggcccaagugcacgggaaauaucccuuccgcgcgcgugucuauucuccacgagguccgaccagugacuucgggcuguuuucccaucaugcaugaucguaccaagauaagacaacugccuaaccuucugagggguuacgaacacauccgguugucaacacauaauguaauuaacgcugagaaugccccagggggacccuauaaaaucggcacuagcggcaguugcccuaacguuaccaaugggaacggauucuuugcaacaauggccugggcugugccaaagaaugacaacaauaaaaccgcaacgaacucccucacuauugaagucccguacaucuguacagagggugaggaucagauaaccguguggggcuuccacucugacaacgaaacucagauggccaagcuguauggggauagcaaaccccagaaguuuacauccucagcuaauggagugaccacgcacuacgucagucaaauuggcgguuucccuaaccagaccgaggacgggggacugccacagagcggccgcaucguuguggauuauaugguacagaagucuggcaaaacagggacuauuaccuaccaaagaggaauccucuuaccccagaagguguggugcgccuccgguaggucaaaagucaucaagggcagccugccucuuauuggggaagcggacuguuugcaugagaaauauggaggccugaauaagaguaaaccauacuacacaggugagcacgcaaaggccauagggaacugccccaucugggugaagacuccgcuaaaacucgcuaauggcaccaaguaucggccucccgccaaacugcuuaaggaacgcggauuuuucggcgcaauugcuggguuucuggagggagguugggaaggcaugaucgccggguggcauggauacacaucucacggcgcgcacgguguugccguggcagcugauuugaaauccacccaggaggccauaaacaagauuacuaagaaucucaacagccugucggaauuagaggucaaaaaucugcagcgacucucuggggcuauggacgagcuucauaacgaaauccuggaguuggaugaaaagguggacgaccuaagagccgauacgaucuccucacaaauugagcuggcaguacuccugaguaaugaaggcaucauuaacagcgaggacgagcaccuucuggccuuggaaaggaaacucaagaaaaugcugggaccauccgcuguugagauaggcaauggguguuucgaaacaaagcauaagugcaaccagaccugcuuagaucggaucgcggcaggaacuuuugacgccggugaguucucucugccuaccuuugauagccuaaauauuacagcugccucacucaacgacgauggccuggacaaccacaccauccuuuuguauuacaguacugcagccuccagccuggcugugacacucaugaucgccauuuucgucguguauauggucucucgugauaaugugucauguaguauaugccuguga

SEQ ID NO: 148639 - RNA, 1758 nt, Artificial Sequence
  derived and/or modified sequence opt3 from hemagglutinin__InfluenzaB__AEP20189
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccgugcuuuuguauuacucaacugccgcuaguucccuggccgucacacucaugaucgcaaucuucguggucuauauggugagccgugauaauguuucuuguucaauuugccuguga

SEQ ID NO: 148640 - RNA, 1758 nt, Artificial Sequence; identical to SEQ ID NO: 148530
  derived and/or modified sequence opt3 from hemagglutinin__InfluenzaB__AEP20200

SEQ ID NO: 148641 - RNA, 1755 nt, Artificial Sequence; identical to SEQ ID NO: 148421
  derived and/or modified sequence opt3 from hemagglutinin__InfluenzaB__AEP20211

SEQ ID NO: 148642 - RNA, 1755 nt, Artificial Sequence
  derived and/or modified sequence opt3 from hemagglutinin__InfluenzaB__AEP20222
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcguuggaaucacuccuagcgccaaggcauccauucuacacgaagugcgcccagucaccucuggcuguuuccccaucaugcaugaucgaacaaagauacgucaacucccuaaucugcuuagagguuacgagaaaaucaggcugucgacucagaacgugauugacgccgaaaaggcuccagggggacccuaucgguugggcaccucaggcagcugcccuaaugcaacaaguaaauccggguuuuucgccaccauggcuugggccguaccacgcgauaacaauaagacggcgacuaacccgcucacaguugaggugcccaauaucuguaccaaagaagaggaccagauuacugucuggggauuucacucugauaacaagacacagaugaagaaucuguacggugacccuaacccacaaaaauucaccagcuccgcaaauggcaucacgacccauuaugugucacagauagggggauuucccgaucagacagaggacggcggucugccucagagugggagaauuguggucgauuacaugguucaaaagccaggaaaaacuggcaccaucguguaucagaggggcauucucuuaccccagaagguauggugcgccagcgggcggucuaaagugaucaagggaucccugccgcuuaucggugaagcugacuguuugcacgagaaauacggcgggcugaacaagucaaagccuuauuacacaggagaacacgccaaagcaauuggcaacugccccauaugggucaagacuccacuaaaacucgcuaaugguaccaaguaccgcccucccgccaaacugcuuaaggagcgaggguucuuuggcgcgaucgccggauuccuggagggcgggugggaaggaaugauugcagguuggcauggcuauacaagccacggggcucauggaguggccguugcugccgauuugaagaguacccaggaggcaaucaacaaaauaacuaagaaucucaacucucuguccgaauuagaggugaaaaaucugcaaagacucagcggcgccauggacgaacuucacaacgagauucuggaguuggacgaaaaggucgaugaccuaagggcugauacgaucucgucucagaucgagcuggcggugcuccuguccaaugaagguauuaucaacucagaggacgaacaccuucuggcauuggagcggaaacucaagaagaugcuggggccaagugccguagauauuggcaauggauguuuugagacaaaacauaagugcaaccagaccugcuuagaccguauagcugccggcacuuucaaugcaggggaauuuagccugcccaccuucgauucccuaaacaucacagccgcuucucucaaugacgauggacuggacaaccacaccauucuuuuguacuauagcacugccgcaucaagucuggcgguuacacucaugaucgcuaucuucauuguguacaugauaucccgcgauaaugucagcuguucuaucugccuguga

SEQ ID NO: 148643 - RNA, 1755 nt, Artificial Sequence; identical to SEQ ID NO: 148527
  derived and/or modified sequence opt3 from hemagglutinin__InfluenzaB__AEP20233

SEQ ID NO: 148644 - RNA, 1755 nt, Artificial Sequence
  derived and/or modified sequence opt3 from hemagglutinin__InfluenzaB__AEP20244
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcaugggaaucacuccuagcgccaaggcauccauucuacacgaaguucgcccagugaccucuggcuguuuccccaucaugcaugaucgaacaaagauacgucaacucccuaaucugcuuagagguuacgagaaaaucaggcugucgacucagaacgucauugacgccgaaaaggcuccagggggacccuaucgguugggcaccucaggcagcugcccuaaugcaacaaguaaauccggguuuuucgccaccauggcuugggccgugccacgcggaaacaauaagacggcgacuaacccgcucacaguagagguuccccacaucuguaccaaagaagaggaucagauuacugugugggguuuucauucugacaauaagacacagaugaagaaccuguacggcgauagcaauccucaaaaauucaccuccucagcaaacgggaucacgacccacuaugucagucagauaggaggcuuuccagaccagacagaggauggugggcugccccagagcggaagaauugugguggacuacaugguccaaaagccuggcaaaacuggcaccaucguuuaucagagggggauucucuuaccacagaagguguggugcgccucuggacgguccaaaguaaucaaggguucacugccccuuaucggcgaagcugauuguuugcacgagaaauacgggggacugaauaagagcaagccguauuacacaggcgaacaugccaaagcaauugguaacugcccuauaugggugaagacuccccuaaaacucgcuaacgggaccaaguaccgcccuccagccaaacugcuuaaggagcgaggcuucuuuggagcgaucgccggcuuccuggaagggggaugggaggguaugauugcaggcuggcacggguauacaagucauggagcucacggcgucgccguggcugccgacuugaagucuacccaggaggcaaucaauaaaauaacuaagaaccucaauucccugagcgaauuagagguuaaaaaccugcaaagacucucgggugccauggaugaacuucacaaugagauucuggaguuggacgaaaagguggacgaucuaagggcugacacgaucucuucccagaucgagcuggcgguccuccugucaaacgaagggauuaucaauagugaggaugaacaucuucuggcauuggagcggaaacucaagaagaugcugggccccagcgccguggacauuggaaacggcuguuuugagacaaaacacaagugcaaucagaccugcuuagaucguauagcugccgggacuuucaacgcaggagaauuuucccugccaaccuucgacucucuaaauaucacagccgcuagccucaacgaugacggucuggauaaucauaccauucuuuuguacuauucaacugccgcaaguucccuggcgguaacacucaugaucgcuaucuucauuguuuacaugauaagccgcgacaacgugucuuguucaaucugccuguga

SEQ ID NO: 148645 - RNA, 1758 nt, Artificial Sequence; identical to SEQ ID NO: 148435
  derived and/or modified sequence opt3 from hemagglutinin__InfluenzaB__AEP20255

SEQ ID NO: 148646 - RNA, 1758 nt, Artificial Sequence
  derived and/or modified sequence opt3 from hemagglutinin__InfluenzaB__AEP20277
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaaaaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagcagggauaacgugucuuguucaauaugccuguga

SEQ ID NO: 148647 - RNA, 1755 nt, Artificial Sequence
  derived and/or modified sequence opt3 from hemagglutinin__InfluenzaB__AEP20299
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaagaauaacaauaaaaacgcgacgaauccacugacuguggaggucccguauauuuguacagaaggagaggaccagaucaccgugugggguuuccauucugauaacaagacucagaugaaaaaucuguacggcgacagcaacccccaaaaguuuacauccucagcaaacggggugaccacgcacuaugucagucagauuggaggcuucccugaucagaccgaggacggugggcucccacagagcggaagaaucguuguggauuacaugaugcaaaagcccggcaaaacaggcacuauaguauaucagcgcgggguguuacugccucagaaggucuggugcgccucuggacgguccaaagugauuaaggguucacuuccauugaucggcgaagcugacugucugcaugagaaauacgggggacuaaauaagagcaaacccuacuauaccggcgaacacgccaaggcaauugguaacugcccgaucuggguuaagacaccucucaaacuggcuaaugggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaucucaaaucuacacaggaggcaauaaacaagaucaccaagaaucugaacuccuuaagcgaacuggaggugaaaaaucuccaaagacuuucgggugccauggacgaacugcauaacgagauuuuggagcuagacgaaaagguagaugaccugagggcugauacuaucucuucccagauagagcucgcgguucugcuuucaaaugaagggauuaucaacagugaggacgaacaccuguuggcacucgagcggaaacugaagaaaauguuaggcccuagcgccguggauaucggaaauggcuguuucgagacgaagcacaagugcaaccagacaugccuggaccguauugcugccgggaccuuuaaugcaggagaguucucccuacccacuuuugauucucucaacaucaccgccgcuagccugaaugacgauggucuugacaaccauacaauuuugcuguacuauucaaccgccgcaaguucccucgcggucacucugaugcuugcuauauucaucguguacauggucagccgcgauaacgugucuuguucaauuugccuguga

SEQ ID NO: 148648 - RNA, 1755 nt, Artificial Sequence
  derived and/or modified sequence opt3 from hemagglutinin__InfluenzaB__AEP20310
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccgcacacuaugucagucagauuggaggcuucccagaccagacggaggauggugggcucccccagagcggaagaaucguuguggacuacaugaugcaaaagccuggcaaaaccggcacaauaguauaucagaggggaguguuacugccacagaaggucuggugcgccucugggcgguccaaagugauuaaggguucacuucccuugaucggcgaagcugauugucugcaugagaaauacgggggacuaaacaagagcaaaccguacuauacuggcgaacacgccaaggcaauugguaauugcccuaucuggguuaagaccccucucaaacuggcuaacgggacaaaguaccgcccacccgccaaacuucugaaggagcgaggcuuuuucggagcgaucgccggcuuuuuggaagggggaugggaagguaugauugcaggcuggcacggguauacuucccauggagcucacggcguggccgucgcugccgaccucaaaucuacccaggaggcaauaaauaagaucacaaagaaccugaauaguuuaagcgaacuggaggugaaaaaccuccaaagacuuucgggugccauggacgaacugcauaaugagauuuuggagcuagaugaaaagguagacgaucugagggcugacaccaucucuucccagauagagcucgcgguucugcuuucaaacgaagggauuaucaauagugaggaugaacaccuguuggcacucgagcggaaacugaagaaaauguuaggccccagcgccguggacaucggaaacggcuguuucgagacuaagcacaagugcaaucagacgugccuggaucguauugcugccgggacauuuaacgcaggagaguucucccuaccaaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgcgacaacgugucuuguucaauuugccuguga

SEQ ID NO: 148649 - RNA, 1758 nt, Artificial Sequence
  derived and/or modified sequence opt3 from hemagglutinin__InfluenzaB__AEP20332
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauccgcucacuauugaaguccccuacaucuguacagagggugaggaucagauaaccguguggggcuuccacagugacaacgaaacucagauggcuaagcuguauggggauuccaagccucagaaauuuacaucuagcgccaacggagugaccacgcacuacgucucccaaauuggcgguuucccaaaucagaccgaggacgggggacugccccagucaggccggaucguuguggauuauaugguacagaagaguggcaaaacagggacuauuaccuaccaacgcggaauccucuuaccucagaagguguggugcgcgagcgguagaucuaaagucaucaagggcucccugccacuuauuggggaagcagacuguuugcaugagaaauauggaggccugaacaagucaaagcccuacuacacaggugagcacgccaaagcuauagggaauugcccgaucugggugaagacuccucuaaaacucgccaacggcaccaaguauaggcccccagcaaaacugcuuaaggaacggggauuuuucggcgcuauugccggguuucuggagggagguugggaaggcaugaucgcgggguggcauggauacacaagccacggcgcccacgguguugcaguggcugccgauuugaagaguacccaggaggcuauaaauaaaauuacuaagaaccucaauucucuguccgaauuagaggucaaaaaccugcagcgccucagcggggccauggacgagcuucauaaugaaauccuggaguuggaugaaaagguggacgaccuacgagcagauacgaucucgucucaaauugagcuggccguacuccuguccaacgaaggcaucauuaauucagaggacgagcaccuucuggcuuuggaaagaaaacucaagaagaugcugggaccuagugcgguugagauaggcaacggguguuucgaaacaaaacauaagugcaaucagaccugcuuagauaggaucgcagccggaacuuuugacgcuggugaguucagccugcccaccuuugauucccuaaacauuacagccgcaucucucaaugacgauggccuggacaaccacaccauccuuuuguauuacagcacugccgcuucaagucuggccgugacacucaugaucgcaauuuucgucguguauauggucucccgggauaacgugagcuguucuauaugccuguga

SEQ ID NO: 148650 - RNA, 1755 nt, Artificial Sequence; identical to SEQ ID NO: 148442
  derived and/or modified sequence opt3 from hemagglutinin__InfluenzaB__AEP20343

SEQ ID NO: 148651 - RNA, 1755 nt, Artificial Sequence; identical to SEQ ID NO: 148442
  derived and/or modified sequence opt3 from hemagglutinin__InfluenzaB__AEP20354

SEQ ID NO: 148652 - RNA, 1755 nt, Artificial Sequence; identical to SEQ ID NO: 148442
  derived and/or modified sequence opt3 from hemagglutinin__InfluenzaB__AEP20365

SEQ ID NO: 148653 - RNA, 1755 nt, Artificial Sequence; identical to SEQ ID NO: 148442
  derived and/or modified sequence opt3 from hemagglutinin__InfluenzaB__AEP20376

SEQ ID NO: 148654 - RNA, 1758 nt, Artificial Sequence
  derived and/or modified sequence opt3 from hemagglutinin__InfluenzaB__AEP20398
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgggauaacgucucuuguucaaucugccuguga

SEQ ID NO: 148655 - RNA, 1758 nt, Artificial Sequence; identical to SEQ ID NO: 148624
  derived and/or modified sequence opt3 from hemagglutinin__InfluenzaB__AEP20409

SEQ ID NO: 148656 - RNA, 1758 nt, Artificial Sequence; identical to SEQ ID NO: 148624
  derived and/or modified sequence opt3 from hemagglutinin__InfluenzaB__AEP20420

SEQ ID NO: 148657 - RNA, 1758 nt, Artificial Sequence; identical to SEQ ID NO: 148624
  derived and/or modified sequence opt3 from hemagglutinin__InfluenzaB__AEP20431

SEQ ID NO: 148658 - RNA, 1758 nt, Artificial Sequence; identical to SEQ ID NO: 148624
  derived and/or modified sequence opt3 from hemagglutinin__InfluenzaB__AEP20442

SEQ ID NO: 148659 - RNA, 1758 nt, Artificial Sequence; identical to SEQ ID NO: 148624
  derived and/or modified sequence opt3 from hemagglutinin__InfluenzaB__AEP20453

SEQ ID NO: 148660 - RNA, 1755 nt, Artificial Sequence; identical to SEQ ID NO: 148442
  derived and/or modified sequence opt3 from hemagglutinin__InfluenzaB__AEQ39027

SEQ ID NO: 148661 - RNA, 1758 nt, Artificial Sequence
  derived and/or modified sequence opt3 from hemagglutinin__InfluenzaB__AEQ39260
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 148662 - RNA, 1758 nt, Artificial Sequence; identical to SEQ ID NO: 148661
  derived and/or modified sequence opt3 from hemagglutinin__InfluenzaB__AEQ39271

SEQ ID NO: 148663 - RNA, 1758 nt, Artificial Sequence
  derived and/or modified sequence opt3 from hemagglutinin__InfluenzaB__AEQ39282
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacggcgacgaacuggauaaucacaccauccuuuuguauuacagcacugccgcuucaagucuggccgugacacucaugaucgcaauuuucgucguguauauggucucccgugacaacgugagcuguucuauaugccuguga

SEQ ID NO: 148664 - RNA, 1758 nt, Artificial Sequence
  derived and/or modified sequence opt3 from hemagglutinin__InfluenzaB__AEQ39315
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacggcgacgggcuggauaaucacaccauccuuuuguauuacagcacugccgcuucaagucuggccgugacacucaugaucgcaauuuucgucguguauauggucucccgugacaacgugagcuguucuauaugccuguga

SEQ ID NO: 148665 - RNA, 1758 nt, Artificial Sequence; identical to SEQ ID NO: 148664
  derived and/or modified sequence opt3 from hemagglutinin__InfluenzaB__AEQ39326

SEQ ID NO: 148666 - RNA, 1758 nt, Artificial Sequence
  derived and/or modified sequence opt3 from hemagglutinin__InfluenzaB__AEQ39337
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgggaacgcaccaggaggccccuauaagaucggcacuucagggagcugcccuaauguuaccaacggaaaugguuucuuugccacaauggcuugggcagugccgaaaaacgacaagaauaaaaccgccacgaacccacucacuauugagguccccuacaucuguacagaaggcgaggaucagauaaccguguggggguuccacagugacaaugagacucagauggcuaagcuguauggagauuccaagccucagaaauuuacaucuagcgccaacggcgugaccacgcacuacgucucccaaauugguggguucccaaaccagaccgaagacggaggccugccccagucaggccgcaucguuguggauuauaugguacagaagagugggaaaacaggaacuauuaccuaccaaagagguauccucuuaccucagaagguguggugcgcgagcggcaggucuaaagucaucaaggggucccugccacuuauuggagaggcagacuguuugcaugaaaaauauggcggucugaauaagucaaagcccuacuacacaggggagcacgccaaagcuauaggcaacugcccgaucugggugaagaaaccucuaaagcucgccaauggaacuaaauaucggcccccagcaaagcugcuuaaggagcgcggcuuuuucggggcuauugccggauuucuggaagguggcugggaggggaugaucgcgggauggcauggcuacaccagccacggugcccacgggguugcaguggcugccgauuugaaaaguacacaggaagcuauaaacaagauuaccaaaaaucucaacucucuguccgaguuagaagucaagaaucugcagcgacucagcggcgccauggacgagcuucauaacgagauccuggaauuggaugagaaaguggacgaccuaagagcagauacuaucucgucucaaauugaacuggccguacuccuguccaaugagggaaucauuaacucagaagacgagcaccuucuggcuuuggagaggaagcucaagaaaaugcugggcccuagugcgguugaaauagggaauggauguuucgagacgaagcauaaaugcaaccagacaugcuuagaucggaucgcagccgguaccuuugacgcuggcgaguucagccugcccacuuuugauucccuaaauauuaccgccgcaucucucaacgacgaugggcuggacaaucacacaauccuuuuguauuacagcaccgccgcuucaagucuggccgugacucucaugaucgcaauuuucgucguguauauggucucccgugauaacgugagcuguucuauaugccuguga

SEQ ID NO: 148667 - RNA, 1758 nt, Artificial Sequence
  derived and/or modified sequence opt3 from hemagglutinin__InfluenzaB__AEQ39348
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaucauccuuuuguauuacagcaccgccgcuucaagucuggccgugacucucaugauugcaauauucgucguguauauggucucccgugauaacgugagcuguucuaucugccuguga

SEQ ID NO: 148668 - RNA, 1758 nt, Artificial Sequence; identical to SEQ ID NO: 148664
  derived and/or modified sequence opt3 from hemagglutinin__InfluenzaB__AEQ39359

SEQ ID NO: 148669 - RNA, 1758 nt, Artificial Sequence
  derived and/or modified sequence opt3 from hemagglutinin__InfluenzaB__AEQ39370
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaguuaacgccgagaaugcaccagggggacccuauaaaauuggcacuucaggcagcugcccuaacgugaccaaugggaacggauucuuugccacaauggcuugggcagucccaaagaaugacaacaauaaaaccgccacgaacagucucacuaucgaagugccguacauuuguacagagggugaggaucagaucaccguguggggcuuccacuccgacaacgaaacucagauggcuaagcuguauggggauucuaaaccccagaaguuuacaagcuccgccaauggagucaccacgcacuacguuucacaaauaggcgguuucccuaaccagaccgaggacgggggacugccacagaguggccgcauugugguagauuauauggugcaaaagagcggcaaaacagggacuaucaccuaccagagagguauucucuuaccccagaaggucuggugcgcgucuggaagguccaaagugaucaagggcucacugccucuuaucggggaagcagacuguuugcaugagaaauauggaggccugaauaagagcaaaccauacuacacaggugagcacgccaaggcuauugggaacugccccauauggguuaagacuccgcuaaaacucgccaauggcaccaaguaucggccucccgcaaaacugcuuaaggaacgcggauuuuucggcgcuaucgccggguuucuggagggagguugggaaggcaugauugcgggguggcauggauacacaagucacggcgcccacgguguggcagucgcugccgauuugaaaucuacccaggaggcuaucaacaagauaacuaagaaucucaacucccugagcgaauuagaggugaaaaaucugcagcgacucucgggggccauggacgagcuucauaacgaaauucuggaguuggaugaaaagguagacgaccuaagagcagauacgaucucuucccaaaucgagcuggccguucuccugucaaaugaaggcauuaucaacagugaggacgagcaccuucuggcuuuggaaaggaaacucaagaaaaugcugggaccaagcgcgguggagauuggcaauggguguuucgaaacaaagcauaagugcaaccagaccugcuuagaucggauagcagccggaacuuuugacgcuggugaguucucccugccuaccuuugauucucuaaauaucacagccgcaagccucaacgacgauggccuggacaaccacaccauucuuuuguauuacucaacugccgcuaguucccuggccgucacacucaugaucgcaaucuucguggucuauauggugagccgugauaauguuucuuguucaauuugccuguga

SEQ ID NO: 148670 - RNA, 1755 nt, Artificial Sequence; identical to SEQ ID NO: 148442
  derived and/or modified sequence opt3 from hemagglutinin__InfluenzaB__AEQ39392

SEQ ID NO: 148671 - RNA, 1755 nt, Artificial Sequence; identical to SEQ ID NO: 148442
  derived and/or modified sequence opt3 from hemagglutinin__InfluenzaB__AEQ39429

SEQ ID NO: 148672 - RNA, 1755 nt, Artificial Sequence; identical to SEQ ID NO: 148442
  derived and/or modified sequence opt3 from hemagglutinin__InfluenzaB__AEQ39440

SEQ ID NO: 148673 - RNA, 1755 nt, Artificial Sequence; identical to SEQ ID NO: 148442
  derived and/or modified sequence opt3 from hemagglutinin__InfluenzaB__AEQ39451

SEQ ID NO: 148674 - RNA, 1758 nt, Artificial Sequence; identical to SEQ ID NO: 148654
  derived and/or modified sequence opt3 from hemagglutinin__InfluenzaB__AEQ39462

SEQ ID NO: 148675 - RNA, 1758 nt, Artificial Sequence; identical to SEQ ID NO: 148661
  derived and/or modified sequence opt3 from hemagglutinin__InfluenzaB__AEQ39484

SEQ ID NO: 148676 - RNA, 1755 nt, Artificial Sequence; identical to SEQ ID NO: 148421
  derived and/or modified sequence opt3 from hemagglutinin__InfluenzaB__AEQ39506

SEQ ID NO: 148677 - RNA, 1758 nt, Artificial Sequence
  derived and/or modified sequence opt3 from hemagglutinin__InfluenzaB__AEQ39517
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugacaacggccuggauaaccacaccauccuuuuguauuacucaacugccgcuaguucccuggccguuacacucaugauugcaauauucguggucuauauggugagccgggacaaugucucuuguucaaucugccuguga

SEQ ID NO: 148678 - RNA, 1758 nt, Artificial Sequence
  derived and/or modified sequence opt3 from hemagglutinin__InfluenzaB__AER27038
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacaaagggugaggaucagauaaccguguggggcuuccacagugacaaugagacucagauggcuaagcucuauggggauuccaaaccacagaaguuuacaucuagcgccaacggagugaccacgcacuacgucucccaaauuggcgguuuccccaaccagaccgaagacgggggacugccucagucaggccgcaucguuguggauuauaugguacagaaaaguggcaagacagggacuauuaccuaccaaagaggaauccugcucccacagaaaguguggugcgcgagcgguaggucuaaggucaucaaaggcuccuuaccccugauuggggaggcagacugucuucaugaaaaguauggaggcuugaauaagucaaaaccguacuacacaggugagcacgccaaggcuauagggaacugcccuaucugggugaaaacuccccugaagcuagccaauggcaccaaauaucggccuccagcaaagcuccugaaggagcgcggauuuuucggcgcuauugccggguuucuugaaggagguugggagggcaugaucgcgggguggcauggauacacaagccacggcgcccacgguauagcaguugcugccgaucugaaaaguacccaggaagcuauuaacaagaucacuaaaaauuugaacucucucuccgagcuggaagugaagaauuuacagcgacugagcggggccauggacgagcuccauaacgagauccuugaacuggaugagaaagucgacgacuugagagcagauacgauuucgucucaaaucgaacuagccgugcugcucuccaaugagggcauuauaaacucagaagacgagcaucugcuugcucuggagaggaaguugaagaaaaugcucggacccagugcgguagaaaucggcaauggguguuucgagacaaagcacaaaugcaaccagaccugccuggaucggauugcagccggaacuuuugacgcuggugaguucagcuuaccaaccuuugauucccugaauaucacagccgcaucucuaaacgacgauggccucgacaaucacaccauccugcuuuauuacagcacugccgcuucaaguuuggccguuacacugaugauugcaauauucguggucuauauggugucccgugauaacgucagcuguucuaucugccucuga

SEQ ID NO: 148679 - RNA, 1758 nt, Artificial Sequence; identical to SEQ ID NO: 148624
  derived and/or modified sequence opt3 from hemagglutinin__InfluenzaB__AER27060

SEQ ID NO: 148680 - RNA, 1758 nt, Artificial Sequence
  derived and/or modified sequence opt3 from hemagglutinin__InfluenzaB__AET10061
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccaaaaaugcaccagggggacccuauaagaucggcacuucaggcagcugcccuaacguuaccaaugggaacggauucuuugccacaauggcuugggcagugccaaagaaugacaagaaccgcaccgccacgaauagucucacuauugaggucccguacaucuguaaagaaggugaggaucagauaacaguguggggcuuccacuccgacaacgagacccagauggcuaagcuguauggggauucuaagccccagaaauuuacuagcuccgccaacggagugacaacccacuacgucucacaaauuggcgguuucccuaaucagacggaagacgggggacugccacagaguggcagaaucguuguggauuauaugguacagaaaagcggcaaaaccgggacaauuacuuaccaaaggggaauccucuuaccccagaagguguggugcgcgucuggucgguccaaagucaucaagggcucacugccucuuauuggggaggcagacuguuugcaugaaaaauauggaggccugaacaagagcaagccauacuacaccggugagcacgccaaagcuauagggaauugccccaucugggugaagacaccgcuaaaacucgccaacggcacuaaguaucgcccucccgcaaaacugcuuaaggagcgaggauuuuucggcgcuauugccggguuucuggaaggagguugggagggcaugaucgcgggguggcauggauacaccagucacggcgcccacgguguugcaguggcugccgauuugaagucuacacaggaagcuauaaauaaaauuaccaagaaccucaauucccugagcgaguuagaagucaaaaaccugcagagacucucgggggccauggacgagcuucauaaugagauccuggaauuggaugagaagguggacgaccuaagggcagauacuaucucuucccaaauugaacuggccguacuccugucaaacgagggcaucauuaauagugaagacgagcaccuucuggcuuuggagcggaaacucaagaagaugcugggaccaagcgcgguugaaauaggcaacggguguuucgagacgaaacauaagugcaaucagacaugcuuagaucguaucgcagccggaaccuuugacgcuggugaguucucccugccuacuuuugauucucuaaacauuaccgccgcaagccucaaugacgauggccuggacaaccacacaauccuuuuguauuacucaaccgccgcuaguucccuggccgugacucucaugaucgcaauuuucgucguguauauggucagccgcgauaacgugucuuguucaauaugccuguga

SEQ ID NO: 148681 - RNA, 1755 nt, Artificial Sequence
  derived and/or modified sequence opt3 from hemagglutinin__InfluenzaB__AET10062
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaucaccccaacaaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauucuccaugaaguccgaccagugacuucuggcuguuuucccaucaugcacgaccguaccaagauaagacaacugccuaaucuucugagggguuaugagaacauccgguugucgacacagaauguaauugaugcagaaaaggccccagggggacccuaccgccucggcacuucaggcagcugcccuaacgcuaccaguaaaaucggguucuuugcaacaauggccugggcuguuccaaaggacaauuauaaaaacgccaccaauccgcugacgguggagguccccuacauuuguaaggaaggagaggaucagaucacugugugggguuuccauuccgacaacaaaacacagaugaagaaucuguauggcgauucuaacccucaaaaguuuaccagcuccgcgaauggggugacuacacacuacgucucacagauaggagacuucccagaucagaccgaggacggcggucucccccagagugggagaauuguuguggauuauaugaugcaaaaaccuggaaagacgggcaccaucguauaccagaggggcguguuacugccacagaaagucuggugcgcaagcgggcggucuaaggugauuaaaggaucccuucccuugaucggugaagccgacugucugcaugagaaguacggcgggcuaaacaaaucaaagccguauuacacaggagaacacgcuaaggccaucggcaacugcccuauuuggguuaaaacuccccucaagcuggcaaaugguaccaaauaucgcccuccagcuaaacuucugaaggagcgaggguuuuucggcgccauagcgggauuuuuggagggcgggugggaaggaaugaucgccgguuggcacggcuacacaagccauggggcacacggaguggcugucgccgcugaccucaagaguacucaggaggccauuaacaagaucaccaaaaaucugaacucuuuauccgaacuggaggugaagaaucuccaaagacuuagcggcgcaauggaugaacugcauaacgagauauuggagcuagacgaaaaaguagaugaccugagggccgauacaauuucgucucagaucgagcucgcuguucugcuuuccaaugaagguaucauuaacucagaggacgaacaccuguuggcgcucgagcggaagcugaaaaagauguuagggcccagugcaguggauaucggcaauggauguuucgagaccaagcacaaaugcaaccagacuugccuggaccguauugccgcuggcacguuuaaugccggggaguucagccuaccaacauuugauucccucaacauaaccgcagccucucugaaugacgauggacuugacaaccauacuaucuugcuguauuacagcaccgcugccucaagucucgcagucacacugaugcuugcgauuuucaucguguauauggucucccgcgacaaugugagcuguucuaucugccuguga

SEQ ID NO: 148682 - RNA, 1755 nt, Artificial Sequence
  derived and/or modified sequence opt3 from hemagglutinin__InfluenzaB__AET10064
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccaucugggguuuccauuccgacaacaagacucagaugaaaaaucuguauggcgauucuaacccucaaaaguuuacaagcuccgcgaauggggugaccacgcacuacgugucacagauaggagacuucccagaucagaccgaggacggcggucucccccagagugggagaauugucguugauuauaugaugcaaaagccuggaaaaacaggcacuaucguguaccagaggggcguauuacugccacagaagguguggugcgcaagcgggcggucuaaagucauuaagggaucccuucccuugaucggugaagccgacugucugcaugagaaauacggcgggcuaaacaagucaaaaccguauuacaccggagaacacgcuaaggccaucggcaacugcccuauuugggugaagacaccccucaaacuggcaaaugguacuaaguaucgcccuccagcuaaacuucugaaggagcgaggguuuuucggcgccauagcgggauuuuuggagggcgggugggaaggaaugaucgccgguuggcacggcuacaccagccauggggcacacggaguugcuguggccgcugaccucaaaaguacacaggaggccauuaacaagaucaccaagaaucugaacucuuuauccgaacuggaggucaaaaaucuccaaagacuuagcggcgcaauggaugaacugcauaacgagauauuggagcuagacgaaaagguggaugaccugagggccgauacuauuucgucucagaucgagcucgcuguacugcuuuccaaugaagguaucauuaacucagaggacgaacaccuguuggcgcucgagcggaaacugaagaaaauguuagggcccagugcaguugauaucggcaauggauguuucgagacgaagcacaagugcaaccagacaugccuggaccguauugccgcuggcaccuuuaaugccggggaguucagccuaccaacuuuugauucccucaacauaaccgcagccucucugaaugacgauggacuugacaaccauacaaucuugcuguauuacagcaccgcugccucaagucucgcagugacucugaugcuugcgauuuucaucgucuauauggugucccgcgacaaugucagcuguucuaucugccuguga

SEQ ID NO: 148683 - RNA, 1755 nt, Artificial Sequence
  derived and/or modified sequence opt3 from hemagglutinin__InfluenzaB__AET10065
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguaaggaaggagaggaucagauuacagugugggguuuccauuccgacaacaaaacccagaugaagaaucuguauggcgauucuaacccucaaaaguuuacuagcuccgcgaauggggugacaacccacuacgucucacagaucggagacuucccagaucagacggaggacggcggucucccccagagugggagaauaguuguggauuauaugaugcaaaaaccuggaaagaccggcacaauuguauaccagaggggcguguuacugccacagaaagucuggugcgcaagcgggcggucuaaggugaucaaaggaucccuucccuugauuggugaagccgacugucugcaugagaaguacggcgggcuaaacaaaucaaagccguauuacacuggagaacacgcuaaggccaucggcaacugcccuaucuggguuaaaaccccucucaagcuggcaaaugguacaaaauaucgcccacccgcuaaacuucugaaagagcgaggguuuuucggcgccauugcgggauuuuuggagggcgggugggaaggaaugauagccgguuggcacggcuacacuagccauggggcacacggaguggcugucgccgcugaccucaagaguacccaggaggccaucaacaagauuacaaagaaucugaacucuuuauccgaacuggaggugaagaaucuccaaagacuuagcggcgcaauggaugaacugcauaacgagaucuuggagcuagacgaaaaaguagaugaccugagggccgauaccauaucgucucagauugagcucgcuguucugcuuuccaaugaagguaucaucaacucagaggacgaacaccuguuggcgcucgagcggaagcugaaaaagauguuagggcccagugcaguggauauuggcaauggauguuucgagacuaagcacaaaugcaaccagacgugccuggaccguaucgccgcuggcacauuuaaugccggggaguucagccuaccaaccuuugauucccucaacauuacugcagccucucugaaugacgauggacuugacaaccauaccauauugcuguauuacagcacagcugccucaagucucgcagucacccugaugcuugcgaucuucauuguguauauggucucccgcgacaaugugagcuguucuaucugccuguga

SEQ ID NO: 148684 - RNA, 1755 nt, Artificial Sequence; identical to SEQ ID NO: 148683
  derived and/or modified sequence opt3 from hemagglutinin__InfluenzaB__AET10066

SEQ ID NO: 148685 - RNA, 1755 nt, Artificial Sequence
  derived and/or modified sequence opt3 from hemagglutinin__InfluenzaB__AET10067
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacugccaccccaacaaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacugccuaaucuucugagggguuaugagaacauacgguugucgacacagaauguaaucgaugccgaaaaggcuccagggggacccuaccgccucggcacuucaggcagcugcccuaacgcaaccaguaaaauuggguucuuugccacaauggcuugggccguuccaaaggacaauuauaaaaacgcgaccaauccgcugacgguggagguccccuacaucuguaaggaaggagaggaucagauuacugugugggguuuccauuccgacaacaaaacacagaugaagaaucuguauggcgauucuaacccucaaaaguuuaccagcuccgcaaauggggugacuacacacuacgucucacagaucggagacuucccagaucagaccgaggacggcggucucccccagagugggagaauaguuguggauuauaugaugcaaaaaccuggaaagacgggcaccauuguauaccagaggggcguguuacugccacagaaagucuggugcgccagcgggcggucuaaggugaucaaaggaucccuucccuugauuggugaagcugacugucugcaugagaaguacggcgggcuaaacaaaucaaagccguauuacacaggagaacacgccaaggcaaucggcaacugcccuaucuggguuaaaacuccccucaagcuggcuaaugguaccaaauaucgcccuccagccaaacuucugaaggagcgaggguuuuucggcgcgauugccggauuuuuggagggcgggugggaaggaaugauagcagguuggcacggcuacacaagccauggggcucacggaguggccgucgcugccgaccucaagaguacucaggaggcaaucaacaagauuaccaaaaaucugaacucuuuauccgaacuggaggugaagaaucuccaaagacuuagcggcgccauggaugaacugcauaacgagaucuuggagcuagacgaaaaaguagaugaccugagggcugauacaauaucgucucagauugagcucgcgguucugcuuuccaaugaagguaucaucaacucagaggacgaacaccuguuggcacucgagcggaagcugaaaaagauguuagggcccagugccguggauauuggcaauggauguuucgagaccaagcacaaaugcaaccagacuugccuggaccguaucgcugccggcacguuuaaugcaggggaguucagccuaccaacauuugauucccucaacauuaccgccgcuucucugaaugacgauggacuugacaaccauacuauauugcuguauuacagcaccgccgcaucaagucucgcggucacacugaugcuugcuaucuucauuguguauauggucucccgcgacaaugugagcuguucuaucugccuguga

SEQ ID NO: 148686 - RNA, 1755 nt, Artificial Sequence
  derived and/or modified sequence opt3 from hemagglutinin__InfluenzaB__AET10068
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccgccccaacaaagaguuacuucgcgaaucugaaagguaccaggacucggggcaaguuguguccggauugcuuaaacuguacagaccuggauguugcucuagggcgccccaugugcgccggaaccacgccuagcgcaaaagccuccauccuccaugaagugcgaccagucacuucuggcuguuuucccauuaugcacgaccguaccaagaucagacaacugccuaaucuucugagggguuaugagaacauacgguugucgacacagaaugugaucgaugcugaaaaggcaccagggggacccuaccgccucggcacuucaggcagcugcccuaacgccaccaguaaaauuggguucuuugcuacaauggccugggcgguaccaaaggacaauuauaaaaacgcaaccaauccgcugacgguugaggugcccuacaucuguaaggaaggagaggaucagauuacugucugggguuuccauuccgacaacaaaacacagaugaagaaucuguauggcgauucuaacccucaaaaguuuaccagcuccgccaauggggugacuacacacuacgugucacagaucggagacuucccagaucagaccgaggacggcggucucccccagagugggagaauagucguugauuauaugaugcaaaaaccuggaaagacgggcaccauuguguaccagaggggcguauuacugccacagaaaguguggugcgcuagcgggcggucuaaggucaucaaaggaucccuucccuugauuggugaagccgacugucugcaugagaaguacggcgggcuaaacaaaucaaagccguauuacacaggagaacacgcaaaggcuaucggcaacugcccuaucugggugaaaacuccccucaagcuggccaaugguaccaaauaucgcccuccagcgaaacuucugaaggagcgaggguuuuucggcgccauugcaggauuuuuggagggcgggugggaaggaaugauagcugguuggcacggcuacacaagccauggggcccacggaguugcuguggccgcagaccucaagaguacucaggaggccaucaacaagauuaccaaaaaucugaacucuuuauccgaacuggaggucaagaaucuccaaagacuuagcggcgcuauggaugaacugcauaacgagaucuuggagcuagacgaaaaaguggaugaccugagggcggauacaauaucgucucagauugagcucgcaguacugcuuuccaaugaagguaucaucaacucagaggacgaacaccuguuggcccucgagcggaagcugaaaaagauguuagggcccagugcuguugauauuggcaauggauguuucgagaccaagcacaaaugcaaccagacuugccuggaccguaucgccgcaggcacguuuaaugccggggaguucagccuaccaacauuugauucccucaacauuaccgcugccucucugaaugacgauggacuugacaaccauacuauauugcuguauuacagcaccgcagcgucaagucucgcugugacacugaugcuugccaucuucauugucuauauggugucccgcgacaaugucagcuguucuaucugccuguga

SEQ ID NO: 148687 - RNA, 1755 nt, Artificial Sequence; identical to SEQ ID NO: 148683
  derived and/or modified sequence opt3 from hemagglutinin__InfluenzaB__AET10069

SEQ ID NO: 148688 - RNA, 1758 nt, Artificial Sequence
  derived and/or modified sequence opt3 from hemagglutinin__InfluenzaB__AET10070
augaaggccaucauugugcugcucauggucguuaccagcaacgcugacagaauaugcacaggcaucacuuccucuaauucaccccacgugguaaaaacggcaacccagggggaggugaaggucacaggagugauuccucuuacuaccacaccaaccaaaagucauuucgccaaccugaaggguacugaaacaaggggcaaauuguguccgaagugccccaauuguaccgauuuagacguugcgcuggggcggccuaagugcacgggaaaaaucccaagcgcucgcguguccauucuacacgagguccgacccgugacuucuggcuguuuuccuaucaugcaugaucguaccaagauaagacaacucccaaaccugcuuagggguuacgaacacauccggcugucgacacauaauguaauuaacgccgagaaugcacccgggggaccuuauaaaaucggcacuucaggcagcugcccaaacguuaccaaugggaacggauucuuugccacaauggcuugggcagugccgaagaaugacaaaaacaagaccgccacgaaucccuugacuauugaagucccuuacaucuguacagagggugaggaucagauaaccguguggggcuuccacagugacaacgaaacucagauggcuaagcucuauggggauuccaaaccacagaaguuuacaucuagcgccaauggagugaccacgcacuacgucucccaaauuggcgguuuccccaaccagaccgaggacgggggacugccucagucaggccgcaucguuguggauuauaugguacagaaaaguggcaagacagggacuauuaccuaccaaagaggaauccugcucccacagaaaguguggugcgcgagcgguaggucuaaggucaucaaaggcuccuuaccccugauuggggaagcagacugucuucaugagaaguauggaggcuugaacaagucaaaaccguacuacacaggugagcacgccaaggcuauagggaauugcccuaucugggugaaaacuccccugaagcuagccaacggcaccaaauaucggccuccagcaaagcuccugaaggaacgcggauuuuucggcgcuauugccggguuucuugagggagguugggaaggcaugaucgcgggguggcauggauacacaagccacggcgcccacgguguugcaguggcugccgaucugaaaaguacccaggaggcuauaaauaagauuacuaaaaaccuuaauucucucuccgaacuggaggucaagaacuuacagcgacugagcggggccauggacgagcuccauaaugaaauccuugagcuggaugaaaaaguggacgacuugagagcagauacgaucucgucucaaauugagcuagccguacugcucuccaacgaaggcaucauuaauucagaggacgagcaccuguuggcucuggaaaggaaguugaagaaaaugcucggacccagugcgguugagauaggcaacggguguuucgaaacaaagcauaaaugcaaucagaccugccuggaucggaucgcagccggaacuuuugacgcuggugaguucagcuuaccaaccuuugauucccugaacauuacagccgcaucucuaaaugacgauggccucgacaaccacaccauccugcuuuauuacagcacugccgcuucaaguuuggccgugacacugaugaucgcaauuuucgucguguauauggucucccgugauaaugugagcuguucuauaugccucuga

SEQ ID NO: 148689 - RNA, 1758 nt, Artificial Sequence; identical to SEQ ID NO: 148624
  derived and/or modified sequence opt3 from hemagglutinin__InfluenzaB__AET10071

SEQ ID NO: 148690 - RNA, 1758 nt, Artificial Sequence; identical to SEQ ID NO: 148624
  derived and/or modified sequence opt3 from hemagglutinin__InfluenzaB__AET10072

SEQ ID NO: 148691 - RNA, 1755 nt, Artificial Sequence
  derived and/or modified sequence opt3 from hemagglutinin__InfluenzaB__AET10073
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguugcgagaacauacgguugucgacucagaauguaaucgaugcagaaaaggccccagggggacccuaucgccucggcaccucaggcagcuguccuaacgcuacaaguaaaauuggguucuuugcaaccauggccugggcuguuccaaaggacaauuacaaaaacgccacgaauccgcugacuguggagguccccuauaucugcaaggaaggagaggaucagauuacagugugggguuuccauuccgacaacaaaacccagaugaagaaucuguacggcgauucuaacccucaaaaguuuacuagcuccgcgaauggggugacaacccacuaugucucacagaucggagacuucccagaucagacggaggacggcggucucccccagagugggagaauaguuguggauuacaugaugcaaaaaccuggaaagaccggcacaauuguauaucagaggggcguguuacugccacagaaagucuggugugcaagcgggcggucuaaggugaucaaaggaucccuucccuugauuggugaagccgacugccugcaugagaaguacggcgggcuaaacaaaucaaagccguacuauacuggagaacacgcuaaggccaucggcaacuguccuaucuggguuaaaaccccucucaagcuggcaaaugguacaaaauaccgcccacccgcuaaacuucugaaagagcgaggguuuuucggcgccauugcgggauuuuuggagggcgggugggaaggaaugauagccgguuggcacggcuauacuagccauggggcacacggaguggcugucgccgcugaccucaagaguacccaggaggccaucaacaagauuacaaagaaucugaacucuuuauccgaacuggaggugaagaaucuccaaagacuuagcggcgcaauggaugaacugcauaacgagaucuuggagcuagacgaaaaaguagaugaccugagggccgauaccauaucgucucagauugagcucgcuguucugcuuuccaaugaagguaucaucaacucagaggacgaacaccuguuggcgcucgagcggaagcugaaaaagauguuagggcccagugcaguggauauuggcaauggaugcuucgagacuaagcacaaaugcaaccagacgugucuggaccguaucgccgcuggcacauuuaaugccggggaguucagccuaccaaccuuugauucccucaacauuacugcagccucucugaaugacgauggacuugacaaccauaccauauugcuguacuauagcacagcugccucaagucucgcagucacccugaugcuugcgaucuucauuguguacauggucucccgcgacaaugugagcugcucuaucugucuguga

SEQ ID NO: 148692 - RNA, 1758 nt, Artificial Sequence
  derived and/or modified sequence opt3 from hemagglutinin__InfluenzaB__AET10074
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaggagucauuucgccaaucugaaggguacugaaacacggggcaaauuguguccgaagugccccaacuguaccgauuuagacguugcgcuggggcgcccuaaaugcacgggaaagaucccaagcgcucgaguguccauucuacacgagguccgucccgugacuucuggcuguuuuccuaucaugcaugauagaaccaagauaaggcaacucccaaaucugcuucgggguuacgaacacauccgccugucgacacauaacguaauuaaugccgagaacgcacccgggggaccuuauaaaaucggcacuucaggcagcugcccaaauguuaccaacgggaauggauucuuugccacaauggcuugggcagugccgaagaacgacaaaaauaagaccgccacgaaccccuugacuauugaagucccuuacaucuguacagagggugaggaucagauaaccguguggggcuuccacagugacaaugaaacucagauggcuaaacucuauggggauuccaagccacagaaguuuacaucuagcgccaacggagugaccacgcacuacgucucccaaauuggcgguuuccccaaccagaccgaggacgggggacugccucagucaggcagaaucguuguggauuauaugguacagaaaaguggcaggacagggacuauuaccuaccaacggggaauccugcucccacagaagguguggugcgcgagcggucgcucuaaagucaucaagggcuccuuaccccugauuggggaagcagacugucuucaugagaaauauggaggcuugaauaagucaaaaccguacuacacaggugagcacgccaaggcuauagggaacugcccuaucugggugaagacuccccugaaacuagccaauggcaccaaguaucgaccuccagcaaaacuccugaaggaaagaggauuuuucggcgcuauugccggguuucuugagggagguugggaaggcaugaucgcgggguggcauggauacacaagccacggcgcccacgguguugcaguggcugccgaucugaaaaguacccaggaggcuauaaacaagauuacuaagaauuugaacucucucuccgaacuggaggucaaaaauuuacagaggcugagcggggccauggacgagcuccauaacgaaauccuugagcuggaugaaaagguggacgacuugcgggcagauacgaucucgucucaaauugagcuagccguacugcucuccaaugaaggcaucauuaacucagaggacgagcaucugcuugcucuggaacguaaauugaagaaaaugcucggacccagugcgguugagauaggcaauggguguuucgaaacaaagcacaagugcaaccagaccugccuggaucgcaucgcagccggaacuuuugacgcuggugaguucagcuuaccaaccuuugauucccugaauauuacagccgcaucucuagacgaugacggccucgauaaccacaccauccugcuuuauuacagcacugccgcuucaaguuuggccgugacacugaugaucgcaauuuucgucguguauauggucuccagagacaaugugagcuguucuauaugccucuga

SEQ ID NO: 148693 - RNA, 1758 nt, Artificial Sequence; identical to SEQ ID NO: 148624
  derived and/or modified sequence opt3 from hemagglutinin__InfluenzaB__AET10076

SEQ ID NO: 148694 - RNA, 1758 nt, Artificial Sequence; identical to SEQ ID NO: 148624
  derived and/or modified sequence opt3 from hemagglutinin__InfluenzaB__AET10077

SEQ ID NO: 148695 - RNA, 1758 nt, Artificial Sequence
  derived and/or modified sequence opt3 from hemagglutinin__InfluenzaB__AET10078
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccguccuccacgaggugcgaccaguaacuucuggcuguuuucccauuaugcaugaucguaccaaaaucagacaacugccuaaucuucugagggguuacgaacacauacgguugucgacacauaacguuaucaaugccgagaacgcaccagggggacccuauaagauuggcacuucaggcagcugcccuaaugugaccaacgggaauggauucuuugccacaauggcuugggcagucccgaaaaacgacaagaauaaaaccgccacgaacccacucacuaucgaagugcccuacauuuguacagagggugaggaucagaucaccguguggggcuuccacagugacaaugaaacucagauggcuaagcuguauggggauuccaagccucagaaauuuacaucuagcgccaacggagucaccacgcacuacguuucccaaauaggcgguuucccaaaccagaccgaggacgggggacugccccagucaggccgcauugugguagauuauauggugcagaagaguggcaaaacagggacuaucaccuaccaaagagguauucucuuaccucagaaggucuggugcgcgagcggaaggucuaaagugaucaagggcucccugccacuuaucggggaagcagacuguuugcaugagaaauauggaggccugaauaagucaaagcccuacuacacaggugagcacgccaaagcuauugggaacugcccgauauggguuaagacuccucuaaaacucgccaauggcaccaaguaucggcccccagcaaaacugcuuaaggaacgcggauuuuucggcgcuaucgccggguuucuggagggagguugggaaggcaugauugcgggguggcauggauacacaagccacggcgcccacgguguggcagucgcugccgauuugaagaguacccaggaggcuaucaacaaaauaacuaagaaucucaacucucuguccgaauuagaggugaaaaaucugcagcgacucagcggggccauggacgagcuucauaacgaaauucuggaguuggaugaaaagguagacgaccuaagagcagauacgaucucgucucaaaucgagcuggccguucuccuguccaaugaaggcauuaucaacucagaggacgagcaccuucuggcuuuggaaaggaaacucaagaagaugcugggaccuagugcgguggagauuggcaauggguguuucgaaacaaaacauaagugcaaccagaccugcuuagaucggauagcagccggaacuuuuaaugcuggugaguucagccugcccaccuuugacucccuaaacaucacagccgcaucucucaaugaagauggccuggacaaccacgccauucuuuuguauuacagcaccgcugccucaagucuggcagucacucucaugaucgcgaucuucguggucuauauggugucccgugauaacguuagcuguucuauuugccuguga

SEQ ID NO: 148696 - RNA, 1758 nt, Artificial Sequence
  derived and/or modified sequence opt3 from hemagglutinin__InfluenzaB__AET10079
augaaggccaucauugugcugcucauggucguuaccagcaacgcugacggcauaugcacagggaucacuuccucuaauucaccccacgugguaaaaacggcaacccagggagaagugaacgucacaggugugauuccucuuacuaccacaccaaccaagagucauuucgccaaucugaaaggcacugaaacaagagggaaguuguguccgaaaugccccaacuguaccgauuuagacguugcgcugggaaggccuaagugcacgggcaagaucccaagcgcucggguguccauucuacacgagguccgccccgugacuucugguuguuuuccuaucaugcaugaucgaaccaaaauacgucaacucccaaaucugcuuagaggguacgaacacaucaggcugucgacacauaacguaauuaaugccgagaacgcacccggaggcccuuauaagaucggcacuucagggagcugcccaaauguuaccaacggaaaugguuucuuuacaaccauggccugggcugugccgaaaaacgacaagaauaaaacggcaacuaaccccuugacaauugaagucccuuacaucuguaccgagggcgaggaucagauaacuguguggggguuccacagugacaaugaaacacagauggccaagcucuauggagauuccaagccacagaaauuuaccucuagcgcuaacggcgugacgacccacuacgucucccaaauugguggguuccccaaccagacagaggacggaggccugccucagucaggccggaucguuguggauuauaugguacagaagagugggaaaacuggaaccauuacauaccaacgcgguauccugcucccacagaagguguggugcgccagcggcagaucuaaagucaucaagggguccuuaccccugauuggagaagcggacugucuucaugagaaauauggcgguuugaauaagucaaagccguacuacacuggggagcacgcaaaagccauaggcaacugcccuaucugggugaagaccccacugaaacuagcuaauggaacaaaguauaggcccccugccaaacuccugaaggaacggggcuuuuucggggcaauugcuggauuucuugaggguggcugggaagggaugaucgccggauggcauggcuacaccagccacggugcgcacgggguugccguggcagcugaucugaagaguacucaggaggccauaaacaaaauuacgaagaauuugaacucucucuccgaacuggaggucgagaauuuacagcgccugagcggcgcuauggacgaacuccauaacgagauccuugaacuggaugagaaaguggacgacuugcgagccgauacaaucucgucucaaauugaacuagcaguacugcucuccaaugagggaaucauuaacucagaggacgaacaucugcuugcccuggagagaaaguugaaaaagaugcucggccccagugcuguugaaauagggaauggauguuucgagaccaagcacaaaugcaaccagacuugccuggauaggaucgcggcagguaccuuugacgccggcgaguucagcuuaccaacauuugauucccugaauauuaccgcugccucucuaaacgacgaugggcucgacaaucacacuauccugcuuuauuacagcacagcagccucaaguuuggcugugacgcugaugaucgccauuuucgucguguauauggucucccgggauaacgugagcuguucuauaugccucuga

SEQ ID NO: 148697 - RNA, 1758 nt, Artificial Sequence; identical to SEQ ID NO: 148624
  derived and/or modified sequence opt3 from hemagglutinin__InfluenzaB__AET10080

SEQ ID NO: 148698 - RNA, 1758 nt, Artificial Sequence; identical to SEQ ID NO: 148624
  derived and/or modified sequence opt3 from hemagglutinin__InfluenzaB__AET10081

SEQ ID NO: 148699 - RNA, 1758 nt, Artificial Sequence
  derived and/or modified sequence opt3 from hemagglutinin__InfluenzaB__AET10082
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugguucagaagaguggcaaaacagggacuaucaccuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacacaggugagcacgccaaagcuauugggaacugcccgaucugggugaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacggugucgcaguggcugccgauuugaagaguacccaggaggcuaucaacaaaaucacuaagaaucucaacucucuguccgaauuagagguuaaaaaucugcagcgacucagcggggccauggacgagcuucauaacgaaauucuggaguuggaugaaaagguggacgaccuaagagcagauacgaucucgucucaaauugagcuggccguccuccuguccaaugaaggcauaaucaacucagaggacgagcaccuucuggcuuuggaaaggaaacucaagaagaugcugggaccuagugcgguggagauuggcaauggguguuucgaaacaaaacauaagugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgugauaacgugagcuguucuauuugccuguga

SEQ ID NO: 148700 - RNA, 1758 nt, Artificial Sequence
  derived and/or modified sequence opt3 from hemagglutinin__InfluenzaB__AET10083
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaaggugccuagcgcucgcgucuccauccuccacgaggugcgaccaguaacuucuggcuguuuucccauuaugcaugaucguaccaaaaucagacaacugccuaaucuucugagggguuacgaacacauacgguugucgacacauaacguuaucaaugccgagaacgcaccagggggacccuauaagauuggcacuucaggcagcugcccuaauaucaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 148701 - RNA, 1758 nt, Artificial Sequence; identical to SEQ ID NO: 148661
  derived and/or modified sequence opt3 from hemagglutinin__InfluenzaB__AET10084

SEQ ID NO: 148702 - RNA, 1758 nt, Artificial Sequence; identical to SEQ ID NO: 148624
  derived and/or modified sequence opt3 from hemagglutinin__InfluenzaB__AET10085

SEQ ID NO: 148703 - RNA, 1758 nt, Artificial Sequence; identical to SEQ ID NO: 148664
  derived and/or modified sequence opt3 from hemagglutinin__InfluenzaB__AET43124

SEQ ID NO: 148704 - RNA, 1758 nt, Artificial Sequence; identical to SEQ ID NO: 148664
  derived and/or modified sequence opt3 from hemagglutinin__InfluenzaB__AET43135

SEQ ID NO: 148705 - RNA, 1758 nt, Artificial Sequence; identical to SEQ ID NO: 148664
  derived and/or modified sequence opt3 from hemagglutinin__InfluenzaB__AET43146

SEQ ID NO: 148706 - RNA, 1758 nt, Artificial Sequence; identical to SEQ ID NO: 148664
  derived and/or modified sequence opt3 from hemagglutinin__InfluenzaB__AET43157

SEQ ID NO: 148707 - RNA, 1758 nt, Artificial Sequence
  derived and/or modified sequence opt3 from hemagglutinin__InfluenzaB__AET43168
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguuacgcuagggcggcccaagugcacuggaaagaucccuagcgcgcgcguguccauucuccacgagguccgaccagugaccucuggcuguuuucccaucaugcaugaucguacaaaaauaagacaacugccuaaucuucugagggguuacgaacacauccgguugucgacucauaacguaauuaaugcugagaacgccccagggggacccuauaagaucggcaccucaggcagcugcccuaauguuacaaacgggaauggauucuuugcaaccauggccugggcugugccgaaaaacgacaagaauaaaacggcaacuaacccacucacaauugaaguccccuacaucuguaccgagggugaggaucagauaacuguguggggcuuccacagugacaaugaaacacagauggccaagcuguauggggauuccaagccucagaaauuuaccucuagcgcuaacggagugacgacccacuacgucucccaaauuggcgguuucccaaaccagacagaggacgggggacugccccagucaggccgcaucguuguggauuauaugguacagaagaguggcaaaacugggaccauuacauaccaaagaggaauccucuuaccucagaagguguggugcgccagcgguaggucuaaagucaucaagggcucccugccacuuauuggggaagcggacuguuugcaugagaaauauggaggccugaauaagucaaagcccuacuacacuggugagcacgcaaaagccauagggaacugcccgaucugggugaagaccccucuaaaacucgcuaauggcacaaaguaucggcccccagccaaacugcuuaaggaacgcggauuuuucggcgcaauugcuggguuucuggagggagguugggaaggcaugaucgccggguggcauggauacaccagccacggcgcgcacgguguugccguggcagcugauuugaagaguacucaggaggccauaaacaaaauuacgaagaaucucaacucucuguccgaauuagaggucaaaaaucugcagcgacucagcggggcuauggacgagcuucauaacgaaauccuggaguuggaugaaaagguggacgaccuaagagccgauacaaucucgucucaaauugagcuggcaguacuccuguccaaugaaggcaucauuaacucagaggacgagcaccuucuggccuuggaaaggaaacucaagaagaugcugggaccuagugcuguugagauaggcaauggguguuucgaaaccaaacauaagugcaaccagacuugcuuagaucggaucgcggcaggaaccuuugacgccggugaguucagccugcccacauuugauucccuaaauauuaccgcugccucucucaacgacgauggccuggacaaucacacuauccuuuuguauuacagcacagcagccucaagucuggcugugacgcucaugaucgccauuuucgucguguauauggucucccgugauaacgugagcuguucuauaugccuguga

SEQ ID NO: 148708 - RNA, 1758 nt, Artificial Sequence; identical to SEQ ID NO: 148664
  derived and/or modified sequence opt3 from hemagglutinin__InfluenzaB__AET43179

SEQ ID NO: 148709 - RNA, 1758 nt, Artificial Sequence; identical to SEQ ID NO: 148664
  derived and/or modified sequence opt3 from hemagglutinin__InfluenzaB__AET43190

SEQ ID NO: 148710 - RNA, 1758 nt, Artificial Sequence
  derived and/or modified sequence opt3 from hemagglutinin__InfluenzaB__AET43201
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgggaacgcaccaggaggccccuauaagaucggcacuucagggagcugcccuaauguuaccaacggaaaugguuucuuugccacaauggcuugggcagugccgaaaaacgacaagaauaaaaccgccacgaacccacucacuauugagguccccuacaucuguacagaaggcgaggaucagauaaccguguggggguuccacagugacaaugagacucagauggcuaagcuguauggagauuccaagccucagaaauuuacaucuagcgccaacggcgugaccacgcacuacgucucccaaauugguggguucccaaaccagaccgaagacggaggccugccccagucaggccgcaucguuguggauuauaugguacagaagagugggaaaacaggaacuauuaccuaccaaagagguauccucuuaccucagaagguguggugcgcgagcggcaggucuaaagucaucaaggggucccugccacuuauuggagaggcagacuguuugcaugaaaaauauggcggucugaauaagucaaagcccuacuacacaggggagcacgccaaagcuauaggcaacugcccgaucugggugaagacuccucuaaaacucgccaauggaaccaaguaucggcccccagcaaaacugcuuaaggagcgcggcuuuuucggggcuauugccggauuucuggaagguggcugggaggggaugaucgcgggauggcauggcuacacaagccacggugcccacgggguugcaguggcugccgauuugaagaguacccaggaagcuauaaacaaaauuacuaagaaucucaacucucuguccgaguuagaagucaaaaaucugcagcgacucagcggcgccauggacgagcuucauaacgagauccuggaauuggaugagaagguggacgaccuaagagcagauacgaucucgucucaaauugaacuggccguacuccuguccaaugagggaaucauuaacucagaagacgagcaccuucuggcuuuggagaggaaacucaagaagaugcugggcccuagugcgguugaaauagggaauggauguuucgagacaaaacauaagugcaaccagaccugcuuagaucggaucgcagccgguacuuuugacgcuggcgaguucagccugcccaccuuugauucccuaaauauuacagccgcaucucucaacgacgaugggcuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 148711 - RNA, 1758 nt, Artificial Sequence; identical to SEQ ID NO: 148664
  derived and/or modified sequence opt3 from hemagglutinin__InfluenzaB__AET43212

SEQ ID NO: 148712 - RNA, 1758 nt, Artificial Sequence; identical to SEQ ID NO: 148664
  derived and/or modified sequence opt3 from hemagglutinin__InfluenzaB__AET43223

SEQ ID NO: 148713 - RNA, 1758 nt, Artificial Sequence; identical to SEQ ID NO: 148710
  derived and/or modified sequence opt3 from hemagglutinin__InfluenzaB__AET50943

SEQ ID NO: 148714 - RNA, 1758 nt, Artificial Sequence; identical to SEQ ID NO: 148664
  derived and/or modified sequence opt3 from hemagglutinin__InfluenzaB__AET50954

SEQ ID NO: 148715 - RNA, 1758 nt, Artificial Sequence; identical to SEQ ID NO: 148664
  derived and/or modified sequence opt3 from hemagglutinin__InfluenzaB__AET50965

SEQ ID NO: 148716 - RNA, 1758 nt, Artificial Sequence; identical to SEQ ID NO: 148664
  derived and/or modified sequence opt3 from hemagglutinin__InfluenzaB__AET50976

SEQ ID NO: 148717 - RNA, 1758 nt, Artificial Sequence; identical to SEQ ID NO: 148664
  derived and/or modified sequence opt3 from hemagglutinin__InfluenzaB__AET74255

SEQ ID NO: 148718 - RNA, 1758 nt, Artificial Sequence; identical to SEQ ID NO: 148710
  derived and/or modified sequence opt3 from hemagglutinin__InfluenzaB__AET74277

SEQ ID NO: 148719 - RNA, 1758 nt, Artificial Sequence; identical to SEQ ID NO: 148664
  derived and/or modified sequence opt3 from hemagglutinin__InfluenzaB__AET74288

SEQ ID NO: 148720 - RNA, 1758 nt, Artificial Sequence
  derived and/or modified sequence opt3 from hemagglutinin__InfluenzaB__AET74299
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguuacgcuagggcggcccaagugcacuggaaagaucccuagcgcgcgcguguccauucuccacgagguccgaccagugaccucuggcuguuuucccaucaugcaugaucguacaaaaauaagacaacugccuaaucuucugagggguuacgaacacauccgguugucgacucauaacguaauuaaugcugagaacgccccagggggacccuauaagaucggcaccucaggcagcugcccuaauguuacaaacgggaauggauucuuugcaaccauggccugggcugugccgaaaaacgacaagaauaaaacggcaacuaacccacucacaauugaaguccccuacaucuguaccgagggugaggaucagauaacuguguggggcuuccacagugacaaugaaacacagauggccaagcuguauggggauuccaagccucagaaauuuaccucuagcgcuaacggagugacgacccacuacgucucccaaauuggcgguuucccaaaccagacagaggacgggggacugccccagucaggccgcaucguuguggauuauaugguacagaagaguggcaaaacugggaccauuacauaccaaagaggaauccucuuaccucagaagguguggugcgccagcgguaggucuaaagucaucaagggcucccugccacuuauuggggaagcggacuguuugcaugagaaauauggaggccugaauaagucaaagcccuacuacacuggugagcacgcaaaagccauagggaacugcccgaucugggugaagaccccucuaaaacucgcuaauggcacaaaguaucggcccccagccaaacugcuuaaggaacgcggauuuuucggcgcaauugcuggguuucuggagggagguugggaaggcaugaucgccggguggcauggauacaccagccacggcgcgcacgguguugccguggcagcugauuugaagaguacucaggaggccauaaacaaaauuacgaauaaccucaauucucuguccgaauuagaggucaagaaccugcagcgacucagcggggcuauggacgagcuucauaaugaaauccuggaguuggaugaaaaaguggacgaccuaagagccgauacaaucucgucucaaauugagcuggcaguacuccuguccaacgaaggcaucauuaauucagaggacgagcaccuucuggccuuggaaaggaagcucaaaaagaugcugggaccuagugcuguugagauaggcaacggguguuucgaaaccaagcauaaaugcaaucagacuugcuuagaucggaucgcggcaggaaccuuugacgccggugaguucagccugcccacauuugauucccuaaacauuaccgcugccucucucaaugacgauggccuggacaaccacacuauccuuuuguauuacagcacagcagccucaagucuggcugugacgcucaugaucgccauuuucgucguguauauggucucccgugauaacgugagcuguucuauaugccuguga

SEQ ID NO: 148721 - RNA, 1758 nt, Artificial Sequence; identical to SEQ ID NO: 148664
  derived and/or modified sequence opt3 from hemagglutinin__InfluenzaB__AET74329

SEQ ID NO: 148722 - RNA, 1758 nt, Artificial Sequence; identical to SEQ ID NO: 148664
  derived and/or modified sequence opt3 from hemagglutinin__InfluenzaB__AET74340

SEQ ID NO: 148723 - RNA, 1758 nt, Artificial Sequence; identical to SEQ ID NO: 148664
  derived and/or modified sequence opt3 from hemagglutinin__InfluenzaB__AET74351

SEQ ID NO: 148724 - RNA, 1758 nt, Artificial Sequence; identical to SEQ ID NO: 148661
  derived and/or modified sequence opt3 from hemagglutinin__InfluenzaB__AEY69077

SEQ ID NO: 148725 - RNA, 1758 nt, Artificial Sequence; identical to SEQ ID NO: 148661
  derived and/or modified sequence opt3 from hemagglutinin__InfluenzaB__AFB77676

SEQ ID NO: 148726 - RNA, 1758 nt, Artificial Sequence
  derived and/or modified sequence opt3 from hemagglutinin__InfluenzaB__AFB77677
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuuaacuguaccgauuuagacguugcgcuggggcggcccaagugcacgggaaagaucccuagcgcucgcguguccauucuacacgagguccgaccagugacuucuggcuguuuccccaucaugcaugaucguaccaaaauaagacaacucccuaaucugcuuagggguuacgaacacauccggcugucgacacauaacguaauuaaugccgagaacgcaccagggggacccuauaagaucggcacuucaggcagcugcccuaauguuaccaacgggaauggauuuuucgccacaauggcuugggcagugccgaaaaacgacaagaauaaaaccgccacgaacccauugacuauugaaguccccuacaucuguacagagggugaggaucagauaaccguguggggcuuucacagugacaaugaaacucagauggcuaagcucuauggggauuccaagccucagaaauucacaucuagcgccaacggagugaccacgcacuacgucucccaaauuggcgguuuuccaaaccagaccgaggacgggggacugccccagucaggccgcaucguuguggauuauaugguacagaagaguggcaaaacagggacuauuaccuaccaaagaggaauccugcucccucagaagguguggugcgcgagcgguaggucuaaagucaucaagggcuccuuaccacugauuggggaagcagacugucuucaugagaaauauggaggcuugaauaagucaaagcccuacuacacaggugagcacgccaaagcuauagggaacugcccgaucugggugaagacuccucugaaacuagccaauggcaccaaguaucggcccccagcaaaacuccugaaggaacgcggauucuuuggcgcuauugccggguuccuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggaccuagugcgguugagauaggcaauggguguuuugaaacaaaacacaagugcaaccagaccugccuggaucggaucgcagccggaacuuucgacgcuggugaguuuagcuuacccaccuucgauucccugaauauuacagccgcaucucuaaacgacgauggccucgacaaucacaccauccugcuuuauuacagcacugccgcuucaaguuuggccgugacacugaugaucgcaauuuucgucguguauauggucucccgugauaacgugagcuguucuauaugccucuga

SEQ ID NO: 148727 - RNA, 1758 nt, Artificial Sequence; identical to SEQ ID NO: 148661
  derived and/or modified sequence opt3 from hemagglutinin__InfluenzaB__AFB77678

SEQ ID NO: 148728 - RNA, 1758 nt, Artificial Sequence; identical to SEQ ID NO: 148661
  derived and/or modified sequence opt3 from hemagglutinin__InfluenzaB__AFB77679

SEQ ID NO: 148729 - RNA, 1758 nt, Artificial Sequence
  derived and/or modified sequence opt3 from hemagglutinin__InfluenzaB__AFB77680
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccaaucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauguaaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccuguga

SEQ ID NO: 148730 - RNA, 1758 nt, Artificial Sequence; identical to SEQ ID NO: 148661
  derived and/or modified sequence opt3 from hemagglutinin__InfluenzaB__AFB77681

SEQ ID NO: 148731 - RNA, 1758 nt, Artificial Sequence
  derived and/or modified sequence opt3 from hemagglutinin__InfluenzaB__AFB77682
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacucagaaucucaacucucuguccgaauuagaggugaagaaucugcaacgacucagcggggccauggacgagcuucauaacgaaauccuggaguuggaugaaaaagucgacgaccuaagagcagauacgauuucgucucagaucgagcuggccgugcuccuguccaaugaaggcauuauaaacucagaggacgagcaccuucuggcuuuggaaaggaagcucaaaaagaugcugggaccuagugcgguagagaucggcaauggguguuucgaaacaaagcauaaaugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccuguga

SEQ ID NO: 148732 - RNA, 1758 nt, Artificial Sequence; identical to SEQ ID NO: 148661
  derived and/or modified sequence opt3 from hemagglutinin__InfluenzaB__AFB77683

SEQ ID NO: 148733 - RNA, 1758 nt, Artificial Sequence; identical to SEQ ID NO: 148661
  derived and/or modified sequence opt3 from hemagglutinin__InfluenzaB__AFB77684

SEQ ID NO: 148734 - RNA, 1758 nt, Artificial Sequence
  derived and/or modified sequence opt3 from hemagglutinin__InfluenzaB__AFB77685
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagacuccuagcgcucgcguguccauccuccacgagguccgaccagugaccucuggcuguuuucccauuaugcaugaucguacaaaaaucagacaacugccuaaucuucugagggguuacgaacacauacgguugucgacucauaacguaaucaaugccgagaacgcaccagggggacccuauaagauuggcaccucaggcagcugcccuaauaucacaaacgggaauggauucuuugccaccauggcuugggcaguuccgaaaaacgacaagaauaaaacggccacuaacccacucacaauugaagugcccuacaucuguaccgagggugaggaucagauaacugucuggggcuuccacagugacaaugaaacacagauggcuaagcuguauggggauuccaagccucagaaauuuaccucuagcgccaacggagugacgacccacuacauuucccaaaucggcgguuucccaaaccagacagaggacgggggacugccccagucaggccgcauuguggucgauuauaugguucagaagagugagaaaacuggcaccaucacauaccaaagagggauccucuuaccucagaagguguggugcgcgagcggaaggucuaaaguaauuaaggguucccugccacuuauaggcgaagcagacuguuugcaugagaaauaugggggacugaauaagucaaagcccuacuacacuggcgaacacgccaaagcuaucgguaacugcccgauuugggugaagaccccucuaaaacucgccaaugggacaaaguaucggcccccagcaaaacugcuuaaggagcgcggcuuuuucggagcuaucgccggcuuucuggaagggggaugggaggguaugauagcgggcuggcauggguacaccagccacggagcccacggcgucgcaguggcugccgauuugaagaguacucaggaagcuauuaacaaaaucacgaagaaucucaacucucuguccgaguuagagguuaaaaaucugcagcgacucagcggugccauggacgaacuucauaacgagauccuggaauuggaugagaagguggacgaccuaagagcagauacaauuucgucucaaaucgaacuggccguccuccuguccaaugaggggauuauaaacucagaggacgaacaccuucuggcuuuggagaggaaacucaagaagaugcugggcccuagugcgguggaaaucggaaauggcuguuucgagaccaaacauaagugcaaccagacuugcuuagaucggauugcagccgggaccuuugacgcuggagaguucagccugcccacauuugauucccuaaauaucaccgccgcaucucucaacgacgauggucuggacaaucacacuauccuuuuguauuacagcacagccgcuucaagucuggccguaacgcucaugauugcaauauucguuguguauauggucucccgugauaacgugagcuguucuaucugccuguga

SEQ ID NO: 148735 - RNA, 1758 nt, Artificial Sequence
  derived and/or modified sequence opt3 from hemagglutinin__InfluenzaB__AFB77686
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccaaagaacgacaagaauaaaaccgccacgaacccgcucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucucaggcuucccaaaccagaccgaggacggugggcugccccagaguggacgcauugucguugauuauauggugcagaaaagcggcaaaacaggcacuaucaccuaccaaagagggauccucuuaccucagaagguauggugcgcgucuggaagguccaaagugauuaaggguucacugccacuuauaggcgaagcagacuguuugcaugagaaauaugggggacugaauaagagcaagcccuacuacacaggcgagcacgccaaagcuaucgguaacugcccgauuugggucaagacuccucuaaaacucgccaaugggaccaaguaucggcccccagcaaaacugcuuaaggaacgcggcuuuuucggagcuaucgccggcuuucuggaagggggaugggaggguaugauagcgggcuggcauggguacacaagucacggagcccacggcguggcaguugcugccgauuugaagucuacccaggaggcuauuaacaaaaucacucagaaucucaacucccugagcgaauuagaggugaagaaucugcaacgacucucgggugccauggacgagcuucauaacgaaauccuggaguuggaugaaaaagucgacgaccuaagagcagauacgauuucuucccagaucgagcuggccgugcuccugucaaaugaagggauuauaaacagugaggacgagcaccuucuggcuuuggaaaggaagcucaaaaagaugcugggcccuagcgcgguagagaucggaaauggcuguuucgaaacaaagcauaaaugcaaccagaccugcuuagaucggauugcagccgggacuuuugacgcuggagaguucucccugcccaccuuugauucucuaaauaucacagccgcaagccucaacgacgauggucuggacaaucacaccauccuuuuguauuacucaacugccgcuaguucccuggccguuacacucaugauugcaauauucguggucuauauggugagccgugauaacgucucuuguucaaucugccuguga

SEQ ID NO: 148736 - RNA, 1758 nt, Artificial Sequence
  derived and/or modified sequence opt3 from hemagglutinin__InfluenzaB__AFB77687
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacaucaaguugucgacacauaacguaauuaaugccgagaacgcaccagggggacccuauaaaaucggcacuucaggcagcugcccuaauguuaccaacgggaauggauucuuugccacaauggcuugggcagugccaaagaacgacaaaaauaagaccgccacgaacccgcucacuauugaaguccccuacaucuguacagagggugaggaucagauaaccguguggggcuuccacagugacaaugaaacucagauggcuaagcuguauggggauuccaaaccucagaaguuuacaucuagcgccaacggagugaccacgcacuacgucucccaaauuggcgguuucccaaaccagaccgaggacgggggacugccccagucaggccggaucguuguggauuauaugguacagaaaaguggcaagacagggacuauuaccuaccaacgcggaauccucuuaccucagaaaguguggugcgcgagcgguagaucuaaggucaucaaaggcucccugccacuuauuggggaagcagacuguuugcaugagaaguauggaggccugaauaagucaaaacccuacuacacaggugagcacgccaaggcuauagggaacugcccgaucugggugaaaacuccucuaaagcucgccaauggcaccaaauauaggcccccagcaaagcugcuuaaggaacggggauuuuucggcgcuauugccggguuucuggagggagguugggaaggcaugaucgcgggguggcauggauacacaagccacggcgcccacgguguugcaguggcugccgauuugaaaaguacccaggaggcuauaaacaagauuacuaaaaaucucaacucucuguccgaauuagaggucaagaaucugcagcgccucagcggggccauggacgagcuucauaacgaaauccuggaguuggaugaaaaaguggacgaccuacgagcagauacgaucucgucucaaauugagcuggccguacuccuguccaaugaaggcaucauuaacucagaggacgagcaccuucuggcuuuggaaagaaagcucaagaaaaugcugggaccuagugcgguugagauaggcaauggguguuucgaaacaaagcauaaaugcaaccagaccugcuuagauaggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgggauaacgugagcuguucuauaugccuguga

SEQ ID NO: 148737 - RNA, 1758 nt, Artificial Sequence
  derived and/or modified sequence opt3 from hemagglutinin__InfluenzaB__AFB77688
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaaggccccucuaaaacucgcaaauggcacuaaguaucggcccccagcuaaacugcuuaaggaacgcggauuuuucggcgccauugcgggguuucuggagggagguugggaaggcaugaucgccggguggcauggauacaccagccacggcgcacacgguguugcuguggccgcugauuugaagaguacacaggaggccauaaacaaaauuaccaagaaucucaacucucuguccgaauuagaggucaaaaaucugcagcgacucagcggggcaauggacgagcuucauaacgaaauccuggaguuggaugaaaagguggacgaccuaagagccgauacuaucucgucucaaauugagcuggcuguacuccuguccaaugaaggcaucauuaacucagaggacgagcaccuucuggcguuggaaaggaaacucaagaagaugcugggaccuagugcaguugagauaggcaauggguguuucgaaacgaaacauaagugcaaccagacaugcuuagaucggaucgccgcuggaaccuuugacgccggugaguucagccugcccacuuuugauucccuaaauauuaccgcagccucucucaacgacgauggccuggacaaucacacaauccuuuuguauuacagcaccgcugccucaagucuggcagugacucucaugaucgcgauuuucgucguguauauggucucccgugauaacgugagcuguucuauaugccuguga

SEQ ID NO: 148738 - RNA, 1758 nt, Artificial Sequence; identical to SEQ ID NO: 148661
  derived and/or modified sequence opt3 from hemagglutinin__InfluenzaB__AFB77689

SEQ ID NO: 148739 - RNA, 1758 nt, Artificial Sequence; identical to SEQ ID NO: 148661
  derived and/or modified sequence opt3 from hemagglutinin__InfluenzaB__AFB77690

SEQ ID NO: 148740 - RNA, 1758 nt, Artificial Sequence; identical to SEQ ID NO: 148699
  derived and/or modified sequence opt3 from hemagglutinin__InfluenzaB__AFE00360

SEQ ID NO: 148741 - RNA, 1758 nt, Artificial Sequence; identical to SEQ ID NO: 148699
  derived and/or modified sequence opt3 from hemagglutinin__InfluenzaB__AFF18534

SEQ ID NO: 148742 - RNA, 1758 nt, Artificial Sequence; identical to SEQ ID NO: 148699
  derived and/or modified sequence opt3 from hemagglutinin__InfluenzaB__AFF18543

SEQ ID NO: 148743 - RNA, 1758 nt, Artificial Sequence; identical to SEQ ID NO: 148661
  derived and/or modified sequence opt3 from hemagglutinin__InfluenzaB__AFG48978

SEQ ID NO: 148744 - RNA, 1758 nt, Artificial Sequence; identical to SEQ ID NO: 148661
  derived and/or modified sequence opt3 from hemagglutinin__InfluenzaB__AFG48997

SEQ ID NO: 148745 - RNA, 1758 nt, Artificial Sequence
  derived and/or modified sequence opt3 from hemagglutinin__InfluenzaB__AFG48998
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugaaacaauggccugggcugugccgaaaaacgacaagaauaaaaccgcaacgaaccccuugacuauugaggucccuuacaucuguacagagggugaagaucagauaaccguguggggcuuccacagugacaaugagacucagauggccaagcucuauggggauuccaagccacagaaauuuacaucuagcgcuaacggagugaccacgcacuacgucucccaaauuggcgguuuccccaaccagaccgaagacgggggacugccucagucaggccgcaucguuguggauuauaugguacagaagaguggcaaaacagggacuauuaccuaccaaagaggaauccugcucccacagaagguguggugcgccagcgguaggucuaaagucaucaagggcuccuuaccccugauuggggaggcggacugucuucaugagaaauauggaggcuugaauaagucaaagccguacuacacaggugaacacgcaaaagccauagggaacugcccuaucugggugaagacuccccugaaacuagcuaauggcaccaaguaucggccuccagccaaacuccugaaggagcgcggauuuuucggcgcaauugcuggguuucuugaaggagguugggagggcaugaucgccggguggcauggauacacaagccacggcgcgcacgguguugccguggcagcugaucugaagaguacccaggaagccauaaacaaaauuacuaagaauuugaacucucucuccgagcuggaggucaaaaauuuacagcgacugagcggggcuauggacgaacuccauaacgagauccuugaacuggaugagaagguggacgacuugagagccgauacgaucucgucucaaauugaacuagcaguacugcucuccaaugagggcaucauuaacucagaggacgaacaucugcuugcccuggagaggaaauugaagaagaugcucggacccagugcuguugaaauaggcaauggguguuucgagacaaaacacaagugcaaccagaccugccuggaucggaucgcggcaggaacuuuugacgccggugaguucagcuuaccaaccuuugauucccugaauauuacagcugccucucuaaacgacgauggccucgacaaucacaccauccugcuuuauuacagcacugcagccucaaguuuggcugugacacugaugaucgccauuuucgucguguauauggucucccgugauaacgugagcuguucuauaugccucuga

SEQ ID NO: 148746 - RNA, 1755 nt, Artificial Sequence
  derived and/or modified sequence opt3 from hemagglutinin__InfluenzaB__AFG49012
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacugccuaaucuucugagagguuaugagaacauaagguugucgacucagaauguaaucgaugcagaaaaagccccagggggacccuaccggcucggcaccucaggcagcugcccuaacgcuacaaguaagauuggguucuuugcaaccauggccugggcuguuccaaaagacaauuauaagaacgccacgaauccgcugacuguggagguccccuacaucuguacagaaggagaggaucagauuaccgugugggguuuccauuccgacaacaaaacucagaugaagaaucuguauggcgauucuaacccucaaaaguuuacaagcuccgcgaauggggugaccacgcacuacgucucacagaucggagacuucccagaucagaccgaggacggcggucucccccagagugggcgcauaguuguggauuauaugaugcaaaaaccuggaaagacaggcacuauuguauaccagagaggcguguuacugccacagaaagucuggugcgcaagcgggaggucuaaggugaucaaaggaucccuucccuugauuggugaagccgacugucugcaugagaaguacggcgggcuaaacaaaucaaagccguauuacaccggagaacacgcuaaggccaucggcaacugcccuaucuggguuaaaacaccccucaagcuggcaaaugguacuaaauaucggccuccagcuaaacuucugaaggagcgcggguuuuucggcgccauugcgagcuuuuuggagggaggcugggaagggaugauagccggauggcacgguuacaccagucauggcgcacacgggguggcugucgccgcugaccucaagucuacacaggaggccaucaacaagauuaccaaaaaucugaacuccuuaagcgaacuggaggugaagaaucuccaacgacuuucgggagcaauggaugaacugcauaacgagaucuuggagcuagacgaaaaaguagaugaccugagagccgauacuauaucuucccagauugagcucgcuguucugcuuucaaaugaaggcaucaucaacagugaggacgaacaccuguuggcgcucgagaggaagcugaaaaagauguuaggucccagcgcaguggauauugggaauggcuguuucgagacgaagcacaaaugcaaccagacaugccuggaccggaucgccgcuggaaccuuuaaugccggcgaguucucccuaccaacuuuugauucucucaacauuaccgcagccagccugaaugacgaugggcuugacaaccauacaauauugcuguauuacucaaccgcugccaguucccucgcagucacucugaugcuugcgaucuucauuguguauauggucagccgugacaaugugucuuguucaaucugccuguga

SEQ ID NO: 148747 - RNA, 1755 nt, Artificial Sequence
  derived and/or modified sequence opt3 from hemagglutinin__InfluenzaB__AFG49013
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuuguacagaaggagaggaucagaucaccgugugggguuuccauucugacaauaaaacucagaugaagaaccuguacggcgauagcaauccccaaaaguuuacauccucagcaaacggggugaccacgcacuaugucagucagauuggaggcuucccugaccagaccgaggauggugggcucccacagagcggacgcaucguuguggacuacaugaugcaaaaacccggcaagacaggcacuauaguauaucagagagggguguuacugccucagaaagucuggugcgccucuggaagguccaaggugauuaaagguucacuuccauugaucggcgaagcugauugucugcaugagaaguacgggggacuaaacaaaagcaagcccuacuauaccggcgaacacgccaaggcaauugguaauugcccgaucuggguuaaaacaccucucaagcuggcuaacgggacuaaauaccggcccccagccaagcugcugaaagagcgcggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaagaucaccaaaaaccuuaauuccuuaagcgaacuggaggugaagaaccuccaacgacuuucgggugccauggacgaacugcauaaugagauuuuggagcuagaugaaaaaguagacgaucugagagcugacacuaucucuucccagauagagcucgcgguucugcuuucaaacgaagggauuaucaauagugaggaugaacaccuguuggcacucgagaggaagcugaaaaagauguuaggcccuagcgccguggacaucggaaacggcuguuucgagacgaagcacaaaugcaaucagacaugccuggaucggauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagccgugacaacgugucuuguucaauuugccuguga

SEQ ID NO: 148748 - RNA, 1755 nt, Artificial Sequence
  derived and/or modified sequence opt3 from hemagglutinin__InfluenzaB__AFH57865
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacuccuaugaaaaaccuguacggcgauagcaauccacagaaguuuacauccucagcgaacggggugaccacgcacuaugucagucaaauuggaggcuuccccgaccagaccgaggauggugggcucccucagagcggaagaaucguuguggacuacaugaugcagaagccaggcaaaacaggcacuauaguauaucaaaggggaguguuacugccccagaaggucuggugcgcaucugggcgguccaaagugauuaaggguucacuuccguugaucggcgaagccgauugucugcaugagaaauacgggggacuaaacaagagcaaaccuuacuauaccggcgaacacgcuaaggccauugguaauugccccaucuggguuaagacaccacucaaacuggcaaacgggacuaaguaccgcccucccgcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccagagacuuucgggugcaauggacgaacugcauaaugagauuuuggagcuagaugaaaagguagacgaucugagggccgacacuaucucuucccaaauagagcucgcuguucugcuuucaaacgaagggauuaucaauagugaggaugaacaccuguuggcgcucgagcggaaacugaagaaaauguuaggcccaagcgcaguggacaucggaaacggcuguuucgagacgaagcacaagugcaaucagacaugccuggaucguauugccgcugggaccuuuaacgccggagaguucucccuacccacuuuugacucucucaauaucaccgcagccagccugaacgaugacggucuugauaaucauacaauuuugcuguacuauucaaccgcugccaguucccucgcagucacucugaugcuugcgauauucaucguguacauggucagccgcgacaacgugucuuguucaauuugccuguga

SEQ ID NO: 148749 - RNA, 1755 nt, Artificial Sequence
  derived and/or modified sequence opt3 from hemagglutinin__InfluenzaB__AFH57876
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagaaccagaugaaaaaucuguacggcgauagcaacccucaaaaguuuacuuccucagcgaacggggugacaacccacuaugucagucagauuggcagcuucccagaccagacggaggauggaggucucccccagucugggagaaucguuguggacuacaugaugcaaaagccuggaaaaaccggcacaauaguauaucagaggggcauuuuacugccacagaagguguggugcgcauccgggcggucaaaagucaucaagggaagccuucccuugauuggugaagccgauugucugcaugagaaauacggcgggcuaaauaagaguaaaccguacuauacuggagaacacgcuaaggccaucggcaacugcccuaucugggugaagaccccucucaaacuggcaaaugguacaaaguaccgcccacccgcuaaacuucugaaggagcgaggguuuuucggcgccauugcgggauuuuuggagggcgggugggaaggaaugauagccgguuggcacggcuauacuucucauggggcacacggaguugcuguggccgcugaccucaaauccacccaggaggccaucaacaagauuacaaagaaucugaacagcuuaucggaacuggaggucaaaaaucuccaaagacuuucuggcgcaauggacgaacugcauaacgagaucuuggagcuagaugaaaagguggacgaucugagggccgacaccauauccucacagauugagcucgcuguacugcuuaguaaugaagguaucaucaacagcgaggaugaacaccuguuggcgcucgagcggaaacugaagaaaauguuagggcccuccgcaguugagauuggcaauggauguuucgaaacuaagcacaagugcaaccagacgugccuggaccguaucgccgcuggcacauuuaaugccggggaguucucucuaccaaccuuugauagccucaacauuacugcagccucacugaaugacgauggacuugacaaccauaccauauugcuguacuauaguacagcugccuccagccucgcagugacccugaugcuugcgaucuucauugucuacauggugucucgcgauaacgucucauguaguaucugccuguga

SEQ ID NO: 148750 - RNA, 1755 nt, Artificial Sequence
  derived and/or modified sequence opt3 from hemagglutinin__InfluenzaB__AFH57942
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagaaucagaugaaaucucuguauggcgauagcaacccucaaaaguuuacuuccucagcgaauggggugacaacccacuacgucagucagaucggagacuucccagaucagacggaggacggcggucucccccagagcgggagaauaguuguggauuauaugaugcaaaagccuggaaaaaccggcacaauuguauaccagaggggcguguuacugccacagaaggucuggugcgcaucugggcgguccaaagugaucaagggaucacuucccuugauuggugaagccgacugucugcaugagaaauacggcgggcuaaacaagagcaaaccguauuacacuggagaacacgcuaaggccaucggcaacugcccuaucuggguuaagacuccccucaaacuggcaaaugguacaaaguaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaaaucuacccaggaggccaucaacaagauuacaaagaaucugaacuccuuaagcgaacuggaggugaaaaaucuccaaagacuuucgggcgcaauggaugaacugcauaacgagaucuuggagcuagacgaaaagguagaugaccugagggccgauaccauaucuucccagauugagcucgcuguucugcuuucaaaugaagguaucaucaacagugaggacgaacaccuguuggcgcucgagcggaaacugaagaaaauguuagggcccagcgcaguggauauuggcaauggauguuucgagacuaagcacaagugcaaccagacgugccuggaccguaucgccgcuggcacauuuaaugccggggaguucucccuaccaaccuuugauucucucaacauuacugcagccagccugaaugacgauggacuugacaaccauaccauauugcuguauuacucaacagcugccaguucccucgcagucacccugaugcuugcgaucuucauuguguauauggucagccgcgacaaugugucuuguucaaucugccuguga

SEQ ID NO: 148751 - RNA, 1752 nt, Artificial Sequence
  derived and/or modified sequence opt3 from hemagglutinin__InfluenzaB__AFH57986
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaacgggccccagggggacccuaucgccucggcaccucaggcagcugcccuaacguuacaaguagagacggguucuuugcuaccauggcaugggccgugccaagggauaauaaaacggcuacuaacccgcugacagucgaggugcccuacauuuguaccaagggagaagaccagaucacugugugggguuuccacuccgaugacaaaacacagaugaagaaucuguauggcgauucuaacccucaaaaauuuaccagcuccgccaauggggucacgacccauuacguuucacagauuggaggcuucccaaaccagacagaggacggugggcucccccagaguggacggaucgugguagauuauauggugcaaaagccuggcaagacuggcaccauagucuaccagcgcgggguguuacugccacagaaaguuuggugcgcgagcggacgaucuaaggugauuaaagguucccuucccuugaucggcgaggcagacugucugcacgaaaaguaugggggacuaaacaaaucaaagccguacuacacaggcgagcacgccaaagcuauugguaauugcccuaucugggucaagacuccccucaagcuggccaacgggaccaaauauagaccuccagcaaagcugcugaaagaaaggggcuuuuucggagcuaucgccggcuuuuuggaagggggaugggaggguaugauugcgggcuggcauggguacacaagccacggagcccauggcguggcaguagcugccgaucucaagaguacccaggaggcuauaaauaaaaucacuaagaaccuuaauucuuuauccgagcuggaaguuaagaaccuccaacggcuuagcggugccauggacgagcugcacaaugaaauuuuggagcuagacgagaaaguggaugaccugcgugcagauacgaucucgucucagauagaacucgccguccugcuuuccaacgaggggauuaucaauucagaagacgagcaccuguuggcucucgaacgcaagcugaaaaagauguuaggccccagugcgguggauaucggaaacggcuguuucgagacaaaacauaagugcaaucagaccugccuggacagaauugcagccgggacuuuuaacgcuggagaguucagccuaccaaccuuugauucccucaauaucacagccgcaucucugaacgacgauggucuugacaaucacaccauuuugcuguauuacagcacugccgcuucaagucucgccgucacacugaugauagcaaucuucauuguguauaugguuuccagggauaacgugagcuguucuaucugccuuuga

SEQ ID NO: 148752 - RNA, 1758 nt, Artificial Sequence
  derived and/or modified sequence opt3 from hemagglutinin__InfluenzaB__AFH58249
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuccagcuaaagugagcauucuccacgaaguccgccccgugacuuccggcuguuuuccuaucaugcaugaucgaaccaagauacgucaacugccaaaccuucugagagguuacgagaggauccgguugucuaaucacaacguaauuaaugccgaagaggcacccgggggaccuuauaaaaucggcacaucgggcucaugcccaaacguuacuaaugggaacggauucuuugccaccauggcuugggcagugccgaagaaugaaaacaauaaaacagccaccaacagccucacgauugagguccccuacaucuguacugagggugaagaccagauaacaguguggggcuuccauagugauuccgagacccagauggcuaagcuguauggggacucuaagccucagaaauuuacuagcuccgccaacggagugacaacccacuacgucucacaaauuggcgguuucccaaaucagacggaagaugggggacugccccagaguggccgcaucguuguggacuauaugguacaaaagagcggcaaaaccgggacaauuacuuaccagagaggaauccucuuaccucagaagguguggugcgcgucugguagguccaaagucaucaagggcucacugccacuuauuggggaggcagauuguuugcacgagaaauauggaggccugaacaagagcaagcccuacuacaccggugaacaugccaaagcuauagggaauugcccgaucugggugaagacaccucuaaaacucgccaacggcacuaaguaucggcccccagcaacccugcuuaaagagcgcggauuuuucggcgcuauugccggguuucuggaaggagguugggagggcaugaucgcgggguggcacggauacacaagucauggcgcccacgguguugcaguggcugccgacuugaagucuacccaggaagcuauaaauaagauuacuaaaaaccucaauucccugagcgaguuagaggucaagaaccugcagcgacucucgggggccauggaugaacuucacaaugagauccuggaauuggacgagaaaguggaugaccuaagagcagacacgaucucuucccaaauugaacuggccguacuccugucaaacgagggcaucauuaauagugaggaugaacaucuucuggcuuuggagaggaagcucaaaaagaugcugggaccuagcgcgguugaaauaggcaacggguguuucgagacaaagcacaaaugcaaucagaccugcuuagaccggaucgcagccggaacuuuuaacgcuggugaguucucccugcccaccuuugauucucuaaauauuacagccgcaagccucaacgacgauggccuggacaaccauaccauccuuuuguauuacucaacugccgcuaguucccuggccgugacacucaugaucgcaauuuucgucguguauauggucagccgugauaaugugucuuguucaauaugccuguga

SEQ ID NO: 148753 - RNA, 1758 nt, Artificial Sequence
  derived and/or modified sequence opt3 from hemagglutinin__InfluenzaB__AFH58260
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaauucagauggcuaagcuguauggggauucuaagccccagaaauuuacuagcuccucaaacggagugacaacccacuacgucagucaaaucggcgguuucccuaaucagacggaggacgggggacugccacagagcggccggauuguuguggauuauaugguacagaagucuggcaaaaccgggacaaucacuuaccaacgcggaauccucuuaccccagaagguguggugcgccuccgguagaucaaaagucauuaagggcagccugccucuuauaggggaagcggacuguuugcaugagagguauggaggccugaacaaaaguaagccauacuacaccggugagcacgcaaaggccaucgggaauugccccauuugggugaaaacaccgcuaaagcucgcuaacggcacuaaauaucggccucccgccaagcugcuuaaagaacgcggauuuuucggcgcaaucgcuggguuucuggagggagguugggaaggcaugauagccggguggcauggauacaccucucacggcgcgcacgguguugccguggcagcugauuugaaguccacacaggaggccauuaauaagaucaccaaaaaccucaauagccugucggaauuagaggucaagaaccugcagcgacucucuggggcuauggacgagcuucauaaugaaauccuggaguuggaugaaaaaguggacgaccuaagagccgauacuauuuccucacaaaucgagcuggcaguacuccugaguaacgaaggcauuauaaauagcgaggacgagcaccuucuggccuuggaaaggaagcucaaaaagaugcugggaccauccgcuguugagaucggcaacggguguuucgaaacgaagcauaaaugcaaucagacaugcuuagaucggauugcggcaggaaccuuugacgccggugaguucucucugccuacuuuugauagccuaaacaucaccgcugccucacucaaugacgauggccuggacaaccacacaauccuuuuguauuacaguaccgcagccuccagccuggcugugacucucaugauugccauauucgucguguauauggucucucgugauaacgugucauguaguaucugccuguga

SEQ ID NO: 148754 - RNA, 1755 nt, Artificial Sequence
  derived and/or modified sequence opt3 from hemagglutinin__InfluenzaB__AFH58271
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaagucaagccagugaccucuggcuguuuucccauuaugcacgaccgaacaaagauccgucaacugccuaaucuucugagagguuaugagaacauaagguugucgacucagaauguaaucgaugcagaaaaagccccagggggacccuaccggcucggcaccucaggcagcugcccuaacgcuacaaguaaguccggguucuuugcaaccauggccugggcuguuccaaaagacaauaacaagaaugccacgaacccgcugacuguggagguccccuauauuuguacagaaggagaggaucagaucaccgugugggguuuccauucugacgauaaaacucagaugaagaaucuguacggcgacagcaacccucaaaaguuuacauccucagcgaauggggugaccacgcacuaugucagucagauuggcagcuucccagaucagaccgaggacggaggucucccccagucugggcgcaucguuguggauuacaugaugcaaaaaccuggaaagacaggcacuauaguauaucagagaggcguguuacugccacagaaagucuggugcgcauccgggaggucaaaggugauuaaaggaagccuucccuugaucggugaagccgacugucugcaugagaaguacggcgggcuaaacaaaaguaagccguacuauaccggagaacacgcuaaggccauuggcaacugcccuaucuggguuaaaacaccccucaagcuggcaaaugguacuaaauaccggccuccagcuaaacuucugaaggagcgcggguuuuucggcgccaucgcgggauuuuuggagggcgggugggaaggaaugauugccgguuggcacggcuauaccucucauggggcacacggaguggcugucgccgcugaccucaaguccacacaggaggccauaaacaagaucaccaaaaaucugaacagcuuaucggaacuggaggugaagaaucuccaacgacuuucuggcgcaauggaugaacugcauaacgagauuuuggagcuagacgaaaaaguagaugaccugagagccgauacuaucuccucacagauagagcucgcuguucugcuuaguaaugaagguauuaucaacagcgaggacgaacaccuguuggcgcucgagaggaagcugaaaaagauguuagggcccuccgcaguggagaucggcaauggauguuucgaaacgaagcacaaaugcaaccagacaugccuggaucggauugccgcuggcaccuuuaaugccggggaguucucucuaccaacuuuugacagccucaacaucaccgcagccucacugaaugaugacggacuugauaaccauacaauuuugcuguacuauaguaccgcugccuccagccucgcagucacucugaugcuugcgauauucaucguguacauggucucucgugacaaugugucauguaguauuugccuguga

SEQ ID NO: 148755 - RNA, 1755 nt, Artificial Sequence; identical to SEQ ID NO: 148754
  derived and/or modified sequence opt3 from hemagglutinin__InfluenzaB__AFH58282

SEQ ID NO: 148756 - RNA, 1758 nt, Artificial Sequence
  derived and/or modified sequence opt3 from hemagglutinin__InfluenzaB__AFH58293
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacgaugaaacucagauggcuaagcuguauggggacuccaagccucagaaauuuacaucuagcgccaauggagugaccacgcacuacgugucccaaaucggcgguuucccaaaccagaccgaggaugggggacugccccagucaggccgcauugucguugacuauauggugcagaagaguggcaaaacagggacuaucaccuaccaaagaggaauccucuuaccucagaagguauggugcgcgagcgguaggucuaaagugauuaagggcucccugccacuuauaggggaagcagauuguuugcaugagaaauauggaggccugaacaagucaaagcccuacuacacaggugagcacgccaaagcuaucgggaauugcccgauuugggucaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgacuugaagaguacccaggaggcuauuaauaaaaucacuaagaaccucaauucucuguccgaauuagaggugaaaaaccugcagcgacucagcggggccauggaugagcuucauaaugaaauccuggaguuggacgaaaaggucgacgaucuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaaugucagcuguucuaucugccuguga

SEQ ID NO: 148757 - RNA, 1755 nt, Artificial Sequence
  derived and/or modified sequence opt3 from hemagglutinin__InfluenzaB__AFH58304
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacgauaagacucagaugaaaaaccuguauggcgacucuaauccucaaaaguuuacaagcuccgcgaacggggugaccacgcacuacgucucacagaucggagauuucccagaccagaccgaggauggcggucucccccagagugggagaauaguuguggacuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaauaagucaaaaccguauuacaccggagaacacgcuaaggccaucggcaacugcccuaucuggguuaagacaccccucaaacuggcaaacgguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaucucaaaaguacacaggaggccaucaauaagauuaccaagaacuuaaauucucuguccgaacuggaggugaaaaaccuccaaagacuuagcggcgcaauggacgaacugcauaaugagaucuuggagcuagaugaaaagguagacgaucugagggccgacacuauaucgucucagauugagcucgcuguucugcuuuccaacgaagguaucaucaauucagaggaugaacaccuguuggcgcucgagcggaaacugaagaaaauguuagggcccagugcaguggacauuggcaacggauguuucgagacgaagcacaagugcaaucagacaugccuggaucguaucgccgcuggcaccuuuaacgccggggaguucagccuaccaacuuuugacucccucaauauuaccgcagccucucugaacgaugacggacuugacaaucauacaauauugcuguauuacagcaccgcugccucaagucucgcagucacucugaugcuugcgaucuucauuguguauauggucucccgcgauaacgugagcuguucuaucugccuguga

SEQ ID NO: 148758 - RNA, 1755 nt, Artificial Sequence; identical to SEQ ID NO: 148757
  derived and/or modified sequence opt3 from hemagglutinin__InfluenzaB__AFH58315

SEQ ID NO: 148759 - RNA, 1755 nt, Artificial Sequence
  derived and/or modified sequence opt3 from hemagglutinin__InfluenzaB__AFH58326
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaaggcgcagaugaaaaaucuguauggcgauucuaacccucaaaaguuuacuagcuccgcaaauggggugacaacccacuacgucucacagaucggagacuucccagaucagacggaggacggcggucccccucagagugggagaauaguuguggauuauaugaugcaaaagccaggaaaaaccggcacaauuguauaccagaggggcgugcucuuaccccagaaggucuggugcgccagcgggcggucuaaagugaucaagggaucccugccgcuuauuggugaagcugacuguuugcaugagaaauacggcgggcugaacaagucaaaaccuuauuacacuggagaacacgccaaggcaaucggcaacugccccaucuggguuaagaccccacuaaaacucgcuaaugguacaaaguaucgcccucccgccaaacugcuuaaggagcgaggguuuuucggcgcgauugccggauuucuggagggcgggugggaaggaaugauagcagguuggcacggcuacacuagccauggggcucacggaguggccgucgcugccgacuugaaaaguacccaggaggcaaucaacaagauuacaaagaaucucaacucucuguccgaauuagaggugaaaaaucugcaaagacucagcggcgccauggaugaacuucauaacgagauccuggaguuggacgaaaagguagaugaccuaagggcugauaccauaucgucucagauugagcuggcgguucuccuguccaaugaagguaucaucaacucagaggacgaacaccuucuggcauuggagcggaaacucaagaaaaugcuggggccaagugccguggauauuggcaauggauguuucgagacuaagcacaagugcaaccagacgugcuuagaccguaucgcugccggcacauuuaaugcaggggaguucagccugcccaccuuugauucccuaaacauuacugccgcuucucucaaugacgauggacuggacaaccauaccauacuuuuguauuacagcacagccgcaucaagucuggcggucacccucaugcuggcuaucuucauuguguauauggucucccgcgacaaugugagcuguucuaucugccuuuga

SEQ ID NO: 148760 - RNA, 1755 nt, Artificial Sequence
  derived and/or modified sequence opt3 from hemagglutinin__InfluenzaB__AFH58337
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaaggcgcagaugaaaaaucuguauggcgauucuaacccucaaaaguuuacuagcuccgcaaauggggugacaacccacuacgucucacagaucggagacuucccagaucagacggaggacggcggucucccccagagugggagaauaguuguggauuauaugaugcaaaagccuggaaaaaccggcacaauuguauaccagaggggcguguuacugccacagaaggucuggugcgccagcgggcggucuaaagugaucaagggaucccuucccuugauuggugaagcugacugucugcaugagaaauacggcgggcuaaacaagucaaaaccguauuacacuggagaacacgccaaggcaaucggcaacugcccuaucuggguuaagaccccucucaaacuggcuaaugguacaaaguaucgcccacccgccaaacuucugaaggagcgaggguuuuucggcgcgauugccggauuuuuggagggcgggugggaaggaaugauagcagguuggcacggcuacacuagccauggggcucacggaguggccgucgcugccgaccucaaaaguacccaggaggcaaucaacaagauuacaaagaaucugaacucuuuauccgaacuggaggugaaaaaucuccaaagacuuagcggcgccauggaugaacugcauaacgagaucuuggagcuagacgaaaagguagaugaccugagggcugauaccauaucgucucagauugagcucgcgguucugcuuuccaaugaagguaucaucaacucagaggacgaacaccuguuggcacucgagcggaaacugaagaaaauguuagggcccagugccguggauauuggcaauggauguuucgagacuaagcacaagugcaaccagacgugccuggaccguaucgcugccggcacauuuaaugcaggggaguucagccuaccaaccuuugauucccucaacauuacugccgcuucucugaaugacgauggacuugacaaccauaccauauugcuguauuacagcacagccgcaucaagucucgcggucacccugaugcuugcuaucuucauuguguauauggucucccgcgacaaugugagcuguucuaucugccuguga

SEQ ID NO: 148761 - RNA, 1758 nt, Artificial Sequence
  derived and/or modified sequence opt3 from hemagglutinin__InfluenzaB__AFH58348
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucggcccauaauguaauuaacgcagagaaugccccagggggacccuauaaaaucggcacaucaggcagcugcccuaacguuacuaaugggaacggauucuuugcuaccauggcaugggccgugccaaagaaugacaacaauaaaacagcuaccaacagucucacgauugaagucccguacaucuguacugagggugaggaucagauaacaguguggggcuuccacuccgacaaggaaacccagauggccaaacuguauggggauucuaagccccagaaguuuacuagcuccgcgaacggagugacaacccacuacgucucacaaauuggcgguuucccuaaucagacggaggacgggggacugccacagaguggccgcaucguuguggauuauaugguacagaaaagcggcaagaccgggacaauuacuuaccaaagaggaauccucuuaccccagaaaguguggugcgcaucugguagguccaaggucaucaaaggcucacugccucuuauuggggaagccgacuguuugcaugagaaguauggaggccugaacaaaagcaagccauacuacaccggugagcacgcuaaggccauagggaauugccccaucugggugaaaacaccgcuaaagcucgcaaacggcacuaaauaucggccucccgcuaagcugcuuaaagaacgcggauuuuucggcgccauugcgggguuucuggagggagguugggaaggcaugaucgccggguggcauggauacaccagucacggcgcacacgguguugcuguggccgcugauuugaagucuacacaggaggccauaaauaagauuaccaaaaaccucaauucccugagcgaauuagaggucaagaaccugcagcgacucucgggggcaauggacgagcuucauaaugaaauccuggaguuggaugaaaaaguggacgaccuaagagccgauacuaucucuucccaaauugagcuggcuguacuccugucaaacgaaggcaucauuaauagugaggacgagcaccuucuggcguuggaaaggaagcucaaaaagaugcugggaccaagcgcaguugagauaggcaacggguguuucgaaacgaagcauaaaugcaaucagacaugcuuagaucggaucgccgcuggaaccuuuaacgccggugaguucucccugccuacuuuugacucucuaaauauuaccgcagccagccucaacgaugacggccuggauaaccacacaauccuuuuguauuacucaaccgcugccaguucccuggcagugacucucaugaucgcgauuuucgucguguauauggucagccgugacaaugugucuuguucaauaugccuguga

SEQ ID NO: 148762 - RNA, 1758 nt, Artificial Sequence
  derived and/or modified sequence opt3 from hemagglutinin__InfluenzaB__AFH58370
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucggcccauaauguaauuaacgcagagaaugccccagggggacccuauaaaaucggcacaucaggcagcugcccuaacguuacuaaugggaacggauucuuugcuaccauggcaugggccgugccaaagaaugacaacaauaaaacagcuaccaacagucucacgauugaagucccguacaucuguacugagggugaggaucagauaacaguguggggcuuccacuccgacaacgaaauucagauggccaagcuguauggggauucuaaaccccagaaguuuaccagcuccgcgaauggagugacuacacacuacgucucacaaaucggcgguuucccuaaccagaccgaggacgggggacugccacagaguggccgcauuguuguggauuauaugguacagaagaguggcaaaacggggaccaucacauaccaaagaggaauccucuuaccccagaagguguggugcgcaucugguagguccaaagucauuaagggcucacugccucuuauaggggaagccgacuguuugcaugagaaauauggaggccugaauaagagcaaaccauacuacacuggugagcacgcuaaggccaucgggaacugccccauuugggugaagaccccgcuaaaacucgcaaauggcacaaaguaucggccucccgcuaaacugcuuaaggaacgcggauuuuucggcgccaucgcgggguuucuggagggagguugggaaggcaugauagccggguggcauggauacacuagccacggcgcacacgguguugcuguggccgcugauuugaaaucuacccaggaggccauuaacaagaucacaaagaaucucaacucccugagcgaauuagaggucaaaaaucugcagcgacucucgggggcaauggacgagcuucauaacgaaauccuggaguuggaugaaaagguggacgaccuaagagccgauaccauuucuucccaaaucgagcuggcuguacuccugucaaaugaaggcauuauaaacagugaggacgagcaccuucuggcguuggaaaggaaacucaagaaaaugcugggaccaagcgcaguugagaucggcaauggguguuucgaaacuaagcauaagugcaaccagacgugcuuagaucggauugccgcuggaacauuuaaugccggugaguucucccugccuaccuuugacucucuaaacaucacugcagccagccucaacgaugacggccuggauaaucacaccauccuuuuguauuacucaacagcugccaguucccuggcagugacccucaugauugcgauauucgucguguauauggucagccgugacaacgugucuuguucaaucugccuguga

SEQ ID NO: 148763 - RNA, 1758 nt, Artificial Sequence
  derived and/or modified sequence opt3 from hemagglutinin__InfluenzaB__AFH58392
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaauccagauggcuaagcuguauggggauuccaagccucagaaauuuacuucuagcgccaacggagugacaacccacuacgugucccaaauuggcgguuucccaaaccagacggaggacgggggacugccccagucaggccgcaucgucguugauuauauggugcagaagaguggcaaaaccgggacaaucacuuaccaaagagguauucucuuaccucagaagguauggugcgcgagcggaaggucuaaagugauaaagggcucccugccacuuaucggggaagcagacuguuugcaugagaaauauggaggccugaauaagucaaagcccuacuacaccggugagcacgccaaagcuauugggaacugcccgaucugggucaagacaccucuaaaacucgccaauggcacuaaguaucggcccccagcaaaacugcuuaaggaacgcggauuuuucggcgcuauagccggguuucuggagggagguugggaaggcaugauugcgggguggcauggauacaccagccacggcgcccacgguguggcaguugcugccgauuugaagaguacacaggaggcuaucaacaaaaucaccaagaaucucaacucucuguccgaauuagaggugaaaaaucugcagcgacucagcggggccauggacgagcuucauaacgaaauucuggaguuggaugaaaaggucgacgaccuaagagcagauacuaucucgucucaaauugagcuggccgugcuccuguccaaugaaggcauaaucaacucagaggacgagcaccuucuggcuuuggaaaggaaacucaagaagaugcugggaccuagugcgguagagauuggcaauggguguuucgaaacgaaacauaagugcaaccagacaugcuuagaucggaucgcagccggaaccuuugacgcuggugaguucagccugcccacuuuugauucccuaaauaucaccgccgcaucucucaacgacgauggccuggacaaucacacaauucuuuuguauuacagcaccgccgcuucaagucuggccguuacucucaugauagcaaucuucguggucuauauggugucccgugauaacgucagcuguucuauuugccuguga

SEQ ID NO: 148764 - RNA, 1758 nt, Artificial Sequence; identical to SEQ ID NO: 148756
  derived and/or modified sequence opt3 from hemagglutinin__InfluenzaB__AFH58403

SEQ ID NO: 148765 - RNA, 1758 nt, Artificial Sequence; identical to SEQ ID NO: 148756
  derived and/or modified sequence opt3 from hemagglutinin__InfluenzaB__AFH58414

SEQ ID NO: 148766 - RNA, 1758 nt, Artificial Sequence; identical to SEQ ID NO: 148756
  derived and/or modified sequence opt3 from hemagglutinin__InfluenzaB__AFH58425

SEQ ID NO: 148767 - RNA, 1758 nt, Artificial Sequence; identical to SEQ ID NO: 148756
  derived and/or modified sequence opt3 from hemagglutinin__InfluenzaB__AFH58436

SEQ ID NO: 148768 - RNA, 1758 nt, Artificial Sequence
  derived and/or modified sequence opt3 from hemagglutinin__InfluenzaB__AFH58458
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacaaacaauguaauuaacgccgagaaugcaccagggggacccuauaagaucggcacuucaggcagcugcccuaacguuaccaaugggaacggauucuuugccacaauggcuugggcagugcccaaaaaugacaagaacaaaaccgccacgaauccgcucacuauugaaguccccuacaucuguacagagggugaggaucagauaaccguguggggcuuccauagugacaacgaaauucagauggcuaagcuguauggggauucccgcccucagaaguuuacuucuagcgccaacggagugacaacccacuacgucucccaaaucggcgguuucccaaaucagacggaggacgggggacugccccagucaggcagaauuguuguggauuauaugguacagaaaaguggcaagaccgggacaaucacuuaccaaaggggaauccucuuaccucagaaaguguggugcgcgagcggucggucuaaggucauuaaaggcucccugccacuuauaggggaagcagacuguuugcacgagaaguauggaggccugaacaaaucaaagcccuacuacaccggugagcaugccaaggcuaucgggaauugcccgauuugggugaaaacaccucuaaagcucgccaacggcacuaaauaucgcccaccagcaaagcugcuuaaagaacgaggauuuuucggcgcuaucgccggguuucuggagggagguugggaaggcaugauagcgggguggcacggauacaccagccauggcgcccacgguguugcaguggcugccgauuugaagaguacacaggaggcuauuaauaagaucaccaaaaaccucaauucucuguccgaauuagaggucaagaaccugcagagacucagcggggccauggacgagcuucacaaugaaauccuggaguuggaugaaaaaguggacgaccuaagggcagauacuauuucgucucaaaucgagcuggccguacuccuguccaacgaaggcauuauaaauucagaggacgagcaucuucuggcuuuggaacggaagcucaaaaagaugcugggaccuagugcgguugagaucggcaacggguguuucgaaacgaagcacaaaugcaaucagacaugcuuagaucguauugcagccggaaccuuugacgcuggugaguucagccugcccacuuuugauucccuaaacaucaccgccgcaucucucaaugacgauggccuggacaaccauacaauccuuuuguauuacagcaccgccgcuucaagucuggccgugacucucaugauugcaauauucgucguguauauggucucccgcgauaacgugagcuguucuaucugccuguga

SEQ ID NO: 148769 - RNA, 1758 nt, Artificial Sequence; identical to SEQ ID NO: 148768
  derived and/or modified sequence opt3 from hemagglutinin__InfluenzaB__AFH58469

SEQ ID NO: 148770 - RNA, 1755 nt, Artificial Sequence; identical to SEQ ID NO: 148750
  derived and/or modified sequence opt3 from hemagglutinin__InfluenzaB__AFH58480

SEQ ID NO: 148771 - RNA, 1755 nt, Artificial Sequence
  derived and/or modified sequence opt3 from hemagglutinin__InfluenzaB__AFH58502
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacgauaagacucagaugaaaucucuguauggcgacagcaacccucaaaaguuuacauccucagcgaauggggugaccacgcacuacgucagucagaucggagauuucccagaccagaccgaggauggcggucucccccagagcgggagaauaguuguggacuauaugaugcaaaagccuggaaaaacaggcacuauuguauaccagaggggcguguuacugccacagaaggucuggugcgcaucugggcgguccaaagugaucaagggaucacuucccuugauuggugaagccgacugucugcaugagaaauacggcgggcuaaacaagagcaaaccguauuacaccggagaacacgcuaaggccaucggcaauugcccuaucuggguuaagacaccccucaaacuggcaaacgguacuaaguaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaucucaaaucuacacaggaggccaucaacaagauuaccaagaaucugaacuccuuaagcgaacuggaggugaaaaaucuccaaagacuuucgggcgcaauggacgaacugcauaacgagaucuuggagcuagaugaaaagguagacgaucugagggccgacacuauaucuucccagauugagcucgcuguucugcuuucaaaugaagguaucaucaacagugaggaugaacaccuguuggcgcucgagcggaaacugaagaaaauguuagggcccagcgcaguggacauuggcaauggauguuucgagacgaagcacaagugcaaccagacaugccuggaucguaucgccgcuggcaccuuuaaugccggggaguucucccuaccaacuuuugacucucucaacauuaccgcagccagccugaaugaugacggacuugacaaccauacaauauugcuguauuacucaaccgcugccaguucccucgcagucacucugaugcuugcgaucuucauuguguauauggucagccgcgauaaugugucuuguucaaucugccuguga

SEQ ID NO: 148772 - RNA, 1758 nt, Artificial Sequence
  derived and/or modified sequence opt3 from hemagglutinin__InfluenzaB__AFH58513
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacgaugaaacucagauggcuaagcucuauggggacuccaagccacagaaauuuacaucuagcgccaauggagugaccacgcacuacgucucccaaauuggcgguuuccccaaccagaccgaggaugggggacugccucagucaggccgcaucguuguggacuauaugguacagaagaguggcaaaacagggacuauuaccuaccaaagaggaauccugcucccacagaagguguggugcgcgagcgguaggucuaaagucaucaagggcuccuuaccccugauuggggaagcagauugucuucaugagaaauauggaggcuugaacaagucaaagccguacuacacaggugagcacgccaaagcuauagggaauugcccuaucugggugaagacuccccugaaacuagccaacggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaccugaagaguacccaggaggcuauaaauaaaauuacuaagaaccuuaauucucucuccgaacuggaggucaaaaacuuacagcgacugagcggggccauggaugagcuccauaaugaaauccuugagcuggacgaaaagguggacgauuugagagcagacacgaucucgucucaaauugagcuagccguacugcucuccaacgaaggcaucauuaauucagaggaugagcaccuguuggcucuggaaaggaaauugaagaagaugcucggacccagugcgguugagauaggcaacggguguuucgaaacaaaacauaagugcaaucagaccugccuggaccggaucgcagccggaacuuuugaugcuggugaguucagcuuaccaaccuuugacucccugaacauuacagccgcaucucuaaaugaugacggccucgauaaccacaccauccugcuuuauuacagcacugccgcuucaaguuuggccgugacacugaugaucgcaauuuucgucguguauauggucucccgugacaaugugagcuguucuauaugccucuga

SEQ ID NO: 148773 - RNA, 1758 nt, Artificial Sequence; identical to SEQ ID NO: 148772
  derived and/or modified sequence opt3 from hemagglutinin__InfluenzaB__AFH58524

SEQ ID NO: 148774 - RNA, 1755 nt, Artificial Sequence
  derived and/or modified sequence opt3 from hemagglutinin__InfluenzaB__AFH58535
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacucaaacaaggggcaaguuguguccgaacugcuuuaauuguaccgauuuagacguugcgcuggggcggcccaaaugcaugggaaacacgccuagcgcuaagguguccauccuacacgaagucaagccagccacuucuggcuguuuccccauuaugcaugaucgcaccaaaauccgacagcucccuaaucugcuucgugguuacgagaacauaagacugucgacaucaaaugugaucaacacugaaaccgcaccagggggacccuauaagguaggcacaagcggcaguugcccuaauguugccaacgggaauggauuuuucaacaccauggcuugggugauuccaaaagacaauaacaagacggcaaucaacccggucacuguggaggugcccuacauuuguuccgaaggugaggaucagaucacagucuggggcuuucacucugacgauaaaacccagauggagagguuguauggggacagcaauccucaaaaguucacuuccucagccaacggaguuacaacccauuacgugagucagauaggcgguuuuccaaaucagacggaagaugaggggcucaagcagagcggacggauuguaguggacuauaugguccaaaaacccggcaagaccggcacaaucguguaccagcgcgggauucugcugccucagaaaguuuggugcgcuucuggaagauccaaggugaucaaagguucacucccauuaaucggcgaagccgauugucugcacgagaaguaugggggacuuaacaaaagcaagcccuacuacacuggcgagcacgcgaaggcaauugguaauugcccgauaugggucaaaaccccuuugaagcuggccaacgggacaaaauauaggcccccagcuaagcuacucaaagaacggggcuucuuuggagccaucgcaggcuuccuggaagggggaugggaggguaugauugcuggcuggcauggguacacaagucacggagcccauggcguggcgguagccgcagaccuuaagucuacccaggaggcuaucaauaagauaacuaaaaaccugaauuauuuguccgaacucgagguuaagaaccugcaacgcuuaagcggugccaugaaugagcugcacgaugaaauucucgagcuugacgaaaaaguggacgaucugcgagcugacaccaucucgucucagaucgaguuggccguccuacuguccaacgaagggauuaucaauucagaggaugagcaccuccuggcacuugaaagaaagcugaaaaagauguugggcccuagugccguggagauuggaaacggcuguuuugaaacuaagcauaaaugcaaucagacgugccucgacaggauagcugcggggacauucaacgcaggagauuuuagccugcccaccuucgacuccuuaaacaucacugccgcuucucugaaugaugacggucuagauaaccacaccauucuccuguacuauagcacagccgcaucaagucuugccgucaccuugaugaucgcuaucuucauuguguacaugguuucccgggacaaugugagcuguucuauaugccuguga

SEQ ID NO: 148775 - RNA, 1752 nt, Artificial Sequence
  derived and/or modified sequence opt3 from hemagglutinin__InfluenzaB__AFH58557
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaacgggccccagggggacccuaucgccucggcaccucaggcagcugcccuaacguuacaaguagagacggguucuuugcuaccauggcaugggccgugccaagggauaauaaaacggcuacuaacccgcugacagucgaggugcccuacauuuguaccaagggagaagaccagaucacugugugggguuuccacuccgaugacaaaacacagaugaagaaucuguauggcgauucuaacccucaaaaauuuaccagcuccgccaauggggucacgacccauuacguuucacagauuggaggcuucccaaaccagacagaggacggugggcucccccagaguggacggaucgugguagauuauauggugcaaaagccuggcaagacuggcaccauagucuaccagcgcgggguguuacugccacagaaaguuuggugcgcgagcggacgaucuaaggugauuaaagguucccuucccuugaucggcgaggcagacugucugcacgaaaaguaugggggacuaaacaaaucaaagccguacuacacaggcgagcacgccaaagcuauugguaauugcccuaucugggucaagacuccccucaagcuggccaacgggaccaaauauagaccuccagcaaagcugcugaaagaaaggggcuuuuucggagcuaucgccggcuuuuuggaagggggaugggaggguaugauugcgggcuggcauggguacacaagccacggagcccauggcguggcaguagcugccgaucucaagaguacccaggaggcuauaaauaaaaucacuaagaaccuuaauucuuuauccgagcuggaaguuaagaaccuccaacggcuuagcggugccauggacgagcugcacaaugaaauuuuggagcuagacgagaaaguggaugaccugcgugcagauacgaucucgucucagauagaacucgccguccugcuuuccaacgaggggauuaucaauucagaagacgagcaccuguuggcucucgaacgcaagcugaaaaagauguuaggccccagugcgguggauaucggaaacggcuguuucgagacaaaacauaagugcaaucagaccugccuggacagaauugcagccgggacuuuuaacgcuggagaguucagcuuuccaaccuucgauucccuaaauaucacagccgcaucucucaacgacgauggucuggacaaucacaccauucuuuuguauuacagcacugccgcuucaagucuggccgucacacucaugauagcaaucuucauuguguauaugguuuccagggauaacgugagcuguucuaucugccuguga

SEQ ID NO: 148776 - RNA, 1755 nt, Artificial Sequence
  derived and/or modified sequence opt3 from hemagglutinin__InfluenzaB__AFJ76224
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggagccccaugugcgugggaaucacuccuuccgcuaaggccucuauucuccacgaaguccggccagugaccucgggcuguuuucccaucaugcaugaucgcacaaagauacgacaacugccuaaucuucugcgugguuacgagaaaaucagauugucaacucagaacguaauuaauaucgaaaaggcaccagggggacccuauaggcucggcaccagcggcaguugcccuaacgccacaucccggucuggguucuuugcuaccauggcaugggccguuccacgcgacaauaacaaaacggcuacuaauccgcugacaguggaggucccccacauuuguaccaaggaagaggaucagaucacuguguggggauuccauagcgacaacaaaacacagaugaagaaucuguacggugauuccaacccucaaaaguuuaccucaagugccaauggcgugacgacccacuaugucagccagauagggggauucccagaccagacagaggauggcggucucccccagucugggagaauuguuguggacuacaugguacaaaaaccuggaaagacuggcaccaucguguaucagaggggcauuuuacugccacagaaagucuggugcgcguccgggcggucaaaggugaucaaaggaagccuucccuugaucggugaagcagauugucugcacgagaaguacggcgggcuaaacaaaaguaagccguauuacacaggagaacaugccaaggcuauuggcaacugcccuauauggguuaaaacuccccucaagcuggccaaugguaccaaauaccgcccuccagcaaaacuucugaaggagcgaggguuuuucggcgcuaucgccggauuuuuggagggcgggugggaaggaaugauugcggguuggcacggcuauacaucucauggggcccacggaguggcagucgcugccgaccucaaguccacccaggaggcuaucaacaagauaacuaaaaaucugaacagcuuaucggaacuggaggugaagaaucuccaaagacuuucuggcgccauggaugaacugcacaacgagauuuuggagcuagacgaaaaaguagacgaucugagggcagacacgaucuccucacagaucgagcucgccguucugcuuaguaaugaagguauuaucaacagcgaggaugaacaucuguuggcucucgagcggaagcugaaaaagauguuagggcccuccgcgguggacauuggcaauggauguuucgagacaaagcacaaaugcaaccagaccugccuggaucguauagcagccggcacuuuuaaugcuggggaguucucucuaccaaccuuugacagccucaacaucacagccgcaucacugaaugaugacggacuugauaaccauaccauuuugcuguacuauaguacugccgcuuccagccucgccgucacacugaugaucgcaaucuucauuguguacaugauaucucgcgacaaugucucauguaguaucugccuuuga

SEQ ID NO: 148777 - RNA, 1755 nt, Artificial Sequence
  derived and/or modified sequence opt3 from hemagglutinin__InfluenzaB__AFJ76235
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggagccccaugugcgugggaaucacuccuuccgcuaaggccucuauucuccacgaaguccggccagugaccucgcgcuguuuucccaucaugcaugaucgaacaaagauacgucaacugccuaaucuucugagaggcuacgagaaaaucagguugucaacucagaacguaauuaauaucgaaaaggcaccaggugggcccuaucggcucggaaccagcggcaguugcccuaacgccacaucccgcucuggcuucuuugcuaccauggcaugggccguuccaagagacaauaacaaaacggcuacuaauccgcugacaguggaggucccccacauuuguaccaaggaagaggaucagaucacuguguggggguuccauagcgacaacaaaacacagaugaagaaucuguacggagauuccaacccucaaaaguuuaccucaagugccaauggugugacgacccacuaugucagccagauaggcggguucccagaccagacagaggauggaggccucccccagucugguaggauuguuguggacuacaugguacaaaaaccugggaagacuggaaccaucguguaucagcggggcauuuuacugccacagaaagucuggugcgcguccggccgcucaaaggugaucaaagggagccuucccuugaucggagaagcagauugucugcacgagaaguacgguggccuaaacaaaaguaagccguauuacacaggggaacaugccaaggcuauuggaaacugcccuauauggguuaaaacuccccucaagcuggccaauggcaccaaauaccgaccuccagcaaaacuucugaaggagagagguuucuucggggcuaucgccggcuuuuuggagggaggcugggaagggaugauugcgggauggcacgguuauacaucucauggcgcccacgggguggcagucgcugccgaccucaaguccacccaggaggcuaucaacaagauaacuaaaaaucugaacagcuuaucggaacuggaggugaagaaucuccaaaggcuuucuggagccauggaugaacugcacaacgagauuuuggagcuagacgaaaaaguagacgaucugcgggcagacacgaucuccucacagaucgagcucgccguucugcuuaguaaugaaggcauuaucaacagcgaggaugaacaucuguuggcucucgagcguaagcugaaaaagauguuaggucccuccgcgguggacauugggaauggcuguuucgagacaaagcacaaaugcaaccagaccugccuggaucgcauagcagccggaacuuuuaaugcuggcgaauuuucucuaccaaccuuugacagccucaacaucacagccgcaucacugaaugaugacgggcuugauaaccauaccauuuugcuguacuauaguacugccgcuuccagccucgccgucacacugaugaucgcaaucuucauuguguacaugauaucuagagacaaugucucauguaguaucugccuuuga

SEQ ID NO: 148778 - RNA, 1755 nt, Artificial Sequence; identical to SEQ ID NO: 148776
  derived and/or modified sequence opt3 from hemagglutinin__InfluenzaB__AFJ76246

SEQ ID NO: 148779 - RNA, 1758 nt, Artificial Sequence; identical to SEQ ID NO: 148530
  derived and/or modified sequence opt3 from hemagglutinin__InfluenzaB__AFJ76268

SEQ ID NO: 148780 - RNA, 1758 nt, Artificial Sequence; identical to SEQ ID NO: 148581
  derived and/or modified sequence opt3 from hemagglutinin__InfluenzaB__AFJ76301

SEQ ID NO: 148781 - RNA, 1755 nt, Artificial Sequence; identical to SEQ ID NO: 148442
  derived and/or modified sequence opt3 from hemagglutinin__InfluenzaB__AFJ76323

SEQ ID NO: 148782 - RNA, 1758 nt, Artificial Sequence
  derived and/or modified sequence opt3 from hemagglutinin__InfluenzaB__AFJ76334
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacucugaaacucagauggcuaagcuguauggggauagcaaaccccagaaguuuacauccucagccaacggagugaccacgcacuacgucagucaaauuggcgguuucccuaaucagaccgaggacgggggacugccacagagcggccgcaucguuguggauuauaugguacagaagucuggcaaaacagggacuauuaccuaccaaagaggaauccucuuaccccagaagguguggugcgcguccgguaggucaaaagucaucaagggcagccugccucuuauuggggaagcagacuguuugcaugagaaauauggaggccugaacaagaguaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguuggaaaggcaugaucgcgggguggcauggauacacaucucacggcgcccacgguguugcaguggcugccgauuugaaguccacccaggaagcuauaaauaagauuacuaaaaaccucaauagccugucggaguuagaagucaagaaccugcagcgacucucuggggccauggacgagcuucauaaugagauccuggaauuggaugagaaaguggacgaccuaagagcagauacgaucuccucacaaauugaacuggccguacuccugaguaacgagggcaucauuaauagcgaagacgagcaccuucuggcuuuggagaggaagcucaaaaagaugcugggaccauccgcgguugaaauaggcaacggguguuucgagacaaagcauaaaugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccgugacacucaugaucgcagucuucguggucuauauggugucucgugauaacguuucauguaguauuugccuguga

SEQ ID NO: 148783 - RNA, 1758 nt, Artificial Sequence; identical to SEQ ID NO: 148530
  derived and/or modified sequence opt3 from hemagglutinin__InfluenzaB__AFJ77327

SEQ ID NO: 148784 - RNA, 1755 nt, Artificial Sequence; identical to SEQ ID NO: 148442
  derived and/or modified sequence opt3 from hemagglutinin__InfluenzaB__AFJ77369

SEQ ID NO: 148785 - RNA, 1755 nt, Artificial Sequence; identical to SEQ ID NO: 148442
  derived and/or modified sequence opt3 from hemagglutinin__InfluenzaB__AFJ77380

SEQ ID NO: 148786 - RNA, 1755 nt, Artificial Sequence
  derived and/or modified sequence opt3 from hemagglutinin__InfluenzaB__AFJ80139
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaagucgcuccggguucuuugcaaccauggccugggcuguuccaagagacaauaacaaaacggccacuaauccgcugacaguggagguccccuacaucuguaccaaggaagaggaucagauuacuguguggggauuccacucugacaacaaaacacagaugaagaaucuguauggugauagcaacccucaaaaguuuaccuccucagcgaauggcgugacgacccauuacgucagucagaucgggggauucccagaccagacagaggauggcggucucccccagagcgggaggauaguuguggacuauaugguacaaaaaccuggaaagacuggcaccauuguguaccagcggggcaucuuacugccacagaaagucuggugcgcaucugggcgcuccaaggugauuaaaggauuucuucccuugaucggugaagccgauugucugcacgagaaguauggcgggcuaaacaaaucaaagccguacuacacaggagaacacgcuaaggccaucggcaacugcccuauuuggguuaaaacuccccucaagcuggcaaaugguaccaaauaucgaccuccagcuaaacuucugaaggagagaggguucuuuggcgccauagcgggauucuuggagggcgggugggaaggaaugaucgccgguuggcauggcuacacaagccacggggcacauggaguggcugucgccgcugaccucaagaguacccaggaggccauuaacaagaucacuaaaaaucugaacucuuuauccgaacuggaggugaagaaucuccaaaggcuuagcggcgcaauggaugaacugcacaacgagauauuggagcuagacgaaaaaguagacgaucugcgggccgacacgauuucgucucagaucgagcucgcuguucugcuuuccaaugaagguaucauuaacucagaggaugaacaccuguuggcgcucgagcguaagcugaaaaagauguuagggcccagugcaguggacaucggcaauggauguuuugagacaaagcauaaaugcaaccagaccugccuggaucgcauugccgcuggcacuuucaaugccggggaauuuagccuaccaaccuucgacucccucaacauaacagcagccucucugaaugaugacggacuugauaaccacaccaucuugcuguauuacagcacugcugccucaagucucgcagucacacugaugauugcgaucuucaucguguauaugauuuccagagacaaugucagcuguucuauaugccuuuga

SEQ ID NO: 148787 - RNA, 1755 nt, Artificial Sequence
  derived and/or modified sequence opt3 from hemagglutinin__InfluenzaB__AFJ80150
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaagucgcuccggguucuuugcaaccauggccugggcuguuccaagagacaauaacaaaacggccacuaauccgcugacaguggagguccccuacaucuguaccaaggaagaggaucagauuacuguguggggauuccacucugacaacaaaacacagaugaagaaucuguauggugauagcaacccucaaaaguuuaccuccucagcgaauggcgugacgacccauuacgucagucagaucgggggauucccagaccagacagaggauggcggucucccccagagcgggaggauaguuguggacuauaugguacaaaaaccuggaaagacuggcaccauuguguaccagcggggcaucuuacugccacagaaagucuggugcgcaucugggcgcuccaaggugauuaaaggaucacuucccuugaucggugaagccgauugucugcacgagaaguauggcgggcuaaacaaaagcaagccguacuacacaggagaacacgcuaaggccaucggcaacugcccuauuuggguuaaaacuccccucaagcuggcaaaugguaccaaauaucgaccuccagcuaaacuucugaaggagagaggguuuuucggcgccauagcgggauuuuuggagggcgggugggaaggaaugaucgccgguuggcauggcuacacaagucacggggcacauggaguggcugucgccgcugaccucaagucuacccaggaggccauuaacaagaucacuaaaaaucugaacuccuuaagcgaacuggaggugaagaaucuccaaaggcuuucgggcgcaauggaugaacugcacaacgagauauuggagcuagacgaaaaaguagacgaucugcgggccgacacgauuucuucccagaucgagcucgcuguucugcuuucaaaugaagguaucauuaacagugaggaugaacaccuguuggcgcucgagcguaagcugaaaaagauguuagggcccagcgcaguggacaucggcaauggauguuucgagacaaagcauaaaugcaaccagaccugccuggaucgcauugccgcuggcacuuuuaaugccggggaguucucccuaccaaccuuugacucucucaacauaacagcagccagccugaaugaugacggacuugauaaccacaccaucuugcuguauuacucaacugcugccaguucccucgcagucacacugaugauugcgaucuucaucguguauaugauuagcagagacaaugucucuuguucaauaugccuuuga

SEQ ID NO: 148788 - RNA, 1755 nt, Artificial Sequence
  derived and/or modified sequence opt3 from hemagglutinin__InfluenzaB__AFJ80161
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaagucgcuccggguucuuugccaccauggcuugggccguaccaagagacaauaacaaaacggcgacuaauccgcugacaguugaggugccccacaucuguaccaaggaagaggaucagauuacugucuggggauuccauucugacaacaaaacacagaugaagaaucuguacggugauagcaacccucaaaaguuuaccuccucagcaaauggcaucacgacccacuaugugagucagauagggggauucccagaccagacagaggauggcggucucccccagagcgggaggauuguggucgacuacaugguucaaaaaccuggaaagacuggcaccaucguguaucagcggggcauuuuacugccacagaaaguauggugcgccucugggcgcuccaaggugaucaaaggaucacuucccuugaucggugaagcugauugucugcacgagaaguacggcgggcuaaacaaaagcaagccguauuacacaggagaacaugccaaggcaauuggcaacugcccuauaugggucaaaacuccccucaagcuggcuaaugguaccaaauaccgaccuccagccaaacuucugaaggagagaggguuuuucggcgcgaucgccggauuuuuggagggcgggugggaaggaaugauugcagguuggcacggcuauacaagucauggggcucacggaguggccguugcugccgaccucaagucuacccaggaggcaaucaacaagauaacuaaaaaucugaacuccuuaagcgaacuggaggugaagaaucuccaaaggcuuucgggcgccauggaugaacugcacaacgagauuuuggagcuagacgaaaaagucgacgaucugcgggcugacacgaucucuucccagaucgagcucgcggugcugcuuucaaaugaagguauuaucaacagugaggaugaacaucuguuggcacucgagcguaagcugaaaaagauguuagggcccagcgccguagacauuggcaauggauguuucgagacaaagcacaaaugcaaccagaccugccuggaucgcauagcugccggcacuuuuaaugcaggggaguucucccuaccaaccuuugacucucucaacaucacagccgcuagccugaaugaugacggacuugauaaccauaccauuuugcuguacuauucaacugccgcaaguucccucgcgguuacacugaugaucgcuaucuucauuguguacaugauauucagagacaaugucagcuguucuaucugccuuuga

SEQ ID NO: 148789 - RNA, 1755 nt, Artificial Sequence
  derived and/or modified sequence opt3 from hemagglutinin__InfluenzaB__AFJ80172
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaaucacuccuagcgcuaaggccuccauucuccacgaaguccgcccagugaccucuggcuguuuucccaucaugcaugaucgaacaaagauacgucaacugccuaaucuucugagagguuacgagaaaaucagguugucgacucagaacguaauuaaugcagaaaaggccccagggggacccuaucggcucggcaccucaggcagcugcccuaacgcuacaagucgcuccggguucuuugcaaccauggccugggcuguuccaagagacaauaacaaaacggccacuaauccgcugacaguggagguccccuacaucuguaccaaggaagaggaucagauuacuguguggggauuccacucugacaacaaaacacagaugaagaaucuguauggugauagcaacccucaaaaguuuaccuccucagcgaauggcgugacgacccauuacgucagucagaucggggacuucccagaucagacagaggacggaggccucccccagagcgguaggauaguuguggauuauaugguacaaaaaccugggaagacuggaaccauuguguaccagcggggcaucuuacugccacagaaagucuggugcgcaucuggccgcuccaaggugauuaaagggucacuucccuugaucggagaagccgacugucugcacgagaaguaugguggccuaaacaaaagcaagccguacuacacaggggaacacgcuaaggccaucggaaacugcccuauuuggguuaaaacuccccucaagcuggcaaauggcaccaaauaucgaccuccagcuaaacuucugaaggagagagguuucuucggggccauagcgggcuuuuuggagggaggcugggaagggaugaucgccggauggcaugguuacacaagucacggcgcacaugggguggcugucgccgcugaucucaagucuacccaggaggccauuaacaagaucacuaaaaaucugaacuccuuaagcgaacuggaggugaagaaucuccaaaggcuuucgggagcaauggacgaacugcacaacgagauauuggagcuagacgaaaaaguagaugaccugcgggccgauacgauuucuucccagaucgagcucgcuguucugcuuucaaaugaaggcaucauuaacagugaggacgaacaccuguuggcgcucgagcguaagcugaaaaagauguuaggucccagcgcaguggauaucgggaauggcuguuucgagacaaagcauaaaugcaaccagaccugccuggaccgcauugccgcuggaacuuuuaaugccggcgaauuuucccuaccaaccuuugauucucucaacauaacagcagccagccugaaugacgaugggcuugacaaccacaccaucuugcuguauuacucaacugcugccaguucccucgcagucacacugaugauugcgaucuucaucguguauaugauuagcagagauaaugucucuuguucaauaugccuuuga

SEQ ID NO: 148790 - RNA, 1755 nt, Artificial Sequence; identical to SEQ ID NO: 148776
  derived and/or modified sequence opt3 from hemagglutinin__InfluenzaB__AFJ80183

SEQ ID NO: 148791 - RNA, 1755 nt, Artificial Sequence; identical to SEQ ID NO: 148787
  derived and/or modified sequence opt3 from hemagglutinin__InfluenzaB__AFJ80194

SEQ ID NO: 148792 - RNA, 1755 nt, Artificial Sequence; identical to SEQ ID NO: 148776
  derived and/or modified sequence opt3 from hemagglutinin__InfluenzaB__AFJ80205

SEQ ID NO: 148793 - RNA, 1755 nt, Artificial Sequence; identical to SEQ ID NO: 148421
  derived and/or modified sequence opt3 from hemagglutinin__InfluenzaB__AFJ80216

SEQ ID NO: 148794 - RNA, 1755 nt, Artificial Sequence; identical to SEQ ID NO: 148776
  derived and/or modified sequence opt3 from hemagglutinin__InfluenzaB__AFJ80227

SEQ ID NO: 148795 - RNA, 1758 nt, Artificial Sequence
  derived and/or modified sequence opt3 from hemagglutinin__InfluenzaB__AFJ80238
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgauucauaauguaaucaacgccgaaaaagcaccagggggacccuauaagauuggcacaucaggcagcugcccuaauguuacuaacgggaauggauucuuugccaccauggcuugggcagugccgaaaaacgacaauaacaagacagccaccaauagucucacgaucgaggucccauacauauguacugaaggugaggaucagauuacaguguggggcuuccacuccgacaacgagacccagauggcuaagcuguauggggauucuaaaccccagaaguuuacuagcuccgccaacggagugacaacccacuacgucucacaaaucggcgguuucccuaaucagacggaagacgggggacugccacagaguggccggauuguuguggauuauaugguacagaaaagcggcaagaccgggacaaucacuuaccaacgcggaauccucuuaccccagaaaguguggugcgcgucugguagauccaaggucauuaaaggcucacugccucuuauaggggaggcagacuguuugcaugaaaaguauggaggccugaacaagagcaaaccauacuacaccggugagcacgccaaggcuaucgggaauugccccauuugggugaaaacaccgcuaaagcucgccaacggcacuaaauauaggccucccgcaaagcugcuuaaggagcggggauuuuucggcgcuaucgccggguuucuggaaggagguugggagggcaugauagcgggguggcauggauacaccagucacggcgcccacgguguugcaguggcugccgauuugaaaucuacacaggaagcuauuaauaagaucaccaaaaaccucaauucccugagcgaguuagaagucaagaaccugcagcgccucucgggggccauggacgagcuucauaaugagauccuggaauuggaugagaaaguggacgaccuacgagcagauacuauuucuucccaaaucgaacuggccguacuccugucaaacgagggcauuauaaauagugaagacgagcaccuucuggcuuuggagagaaagcucaagaaaaugcugggaccaagcgcgguugaaaucggcaacggguguuucgagacgaagcauaaaugcaaucagacaugcuuagauaggauugcagccggaaccuuugacgcuggugaguucucccugccuacuuuugauucucuaaacaucaccgccgcaagccucaaugacgauggccuggacaaccacacaauccuuuuguauuacucaaccgccgcuaguucccuggccgugacucucaugauugcaauauucgucguguauauggucagccgggauaacgugucuuguucaaucugccuguga

SEQ ID NO: 148796 - RNA, 1755 nt, Artificial Sequence
  derived and/or modified sequence opt3 from hemagglutinin__InfluenzaB__AFJ80656
augaaggccaucauugugcugcucauggucguuaccagcaacgcugacagaauaugcacaggcaucacuuccucuaauucaccccacgugguaaggacggcaacccagggggaagugaacgucacaggagugauuccucuuacuaccacaccaaccaaaagucauuucgccaaucugaaggguacuaaaacacggggcaaguuguguccgaccugcuuaaacuguacggaucuggacguugcgcuagggcgccccaugugcgugggaaucacuccuagcgcuaaagccuccauucuccacgaaguccgaccagugaccucuggcuguuuucccaucaugcaugaucguacaaagauaagacaacugccuaaucuucugagggguuacgagaagauccgguugucgacucagaacguaauuaaugcagaaaaagccccagggggacccuaucgccucggcaccucaggcagcugcccuaacgcuacaaguagauccggguucuuugcaaccauggccugggcuguuccaagggacaauaacaagacggccacuaauccgcugacaguggaggucccccacaucuguaccaaagaagaggaucagauuacuguguggggauuccauucugacaacaagacacagaugaaaaaucuguacggugauagcaacccucaaaaguuuaccuccucagcgaauggcgugacgacccacuaugucagucagaucgggggauucccagaccagacagaggauggcggucucccccagagcgggcggauaguuguggacuacaugguacaaaagccuggaaaaacuggcaccauuguguaucagcgcggcaucuuacugccacagaaggucuggugcgcaucugggcgauccaaagugauuaagggaucacuucccuugaucggugaagccgauugucugcacgagaaauacggcgggcuaaacaagagcaaaccguauuacacaggagaacaugcuaaggccaucggcaacugcccuauuuggguuaagacuccccucaaacuggcaaaugguaccaaguacagaccuccagcuaaacuucugaaggagaggggguuuuucggcgccauagcgggauuuuuggagggcgggugggaaggaaugaucgccgguuggcacggcuauacaagucauggggcacacggaguggcugucgccgcugaccucaaaucuacccaggaggccauuaacaagaucacuaagaaucugaacuccuuaagcgaacuggaggugaaaaaucuccaacggcuuucgggcgcaauggaugaacugcacaacgagauauuggagcuagacgaaaagguagacgaucugcgugccgacacgauuucuucccagaucgagcucgcuguucugcuuucaaaugaagguaucauuaacagugaggaugaacaucuguuggcgcucgagcgcaaacugaagaaaauguuagggcccagcgcaguggacaucggcaauggauguuucgagacaaagcacaagugcaaccagaccugccuggauagaauugccgcuggcacuuuuaaugccggggaguucucccuaccaaccuuugacucucucaacauaacagcagccagccugaaugaugacggacuugauaaccauaccaucuugcuguacuauucaacugcugccaguucccucgcagucacacugaugauugcgaucuucaucguguacaugauuagcagggacaaugucucuuguucaauaugccuuuga

SEQ ID NO: 148797 - RNA, 1755 nt, Artificial Sequence; identical to SEQ ID NO: 148776
  derived and/or modified sequence opt3 from hemagglutinin__InfluenzaB__AFJ80667

SEQ ID NO: 148798 - RNA, 1755 nt, Artificial Sequence; identical to SEQ ID NO: 148776
  derived and/or modified sequence opt3 from hemagglutinin__InfluenzaB__AFJ80678

SEQ ID NO: 148799 - RNA, 1755 nt, Artificial Sequence; identical to SEQ ID NO: 148776
  derived and/or modified sequence opt3 from hemagglutinin__InfluenzaB__AFJ80689

SEQ ID NO: 148800 - RNA, 1755 nt, Artificial Sequence
  derived and/or modified sequence opt3 from hemagglutinin__InfluenzaB__AFJ80711
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaucaagaguuacuucgccaaucugaaagguaccaagacuaggggcaaauuguguccggauugcuuaaacuguacagaccuggauguugcgcuagggcggcccaugugcgugggaaccacgccuagcgcuaaggccuccauucuccaugaaguccgcccagugacuucuggcuguuuucccaucaugcacgaccgaaccaagauacgucaacugccuaaucuucugagagguuaugagaacaucagguugucgacacagaauguaauugaugcagaaaaagccccagggggacccuaccggcucggcacuucaggcagcugcccuaacgcuaccaguaaguccggguucuuugcaacaauggccugggcuguuccaaaagacaauaacaagaaugccaccaacccgcugacgguggagguccccuauguguguacugaaggagaggaucagaucacagugugggguuuccauucugacaauaaaacccagaugaagaaccuguacggcgauagcaauccucaaaaguuuacuuccucagcgaacggggucacaacccacuauguuagucagauuggaggcuucccagaccagacggaggauggugggcucccccagagcggacgcaucgugguagacuacauggugcaaaaaccuggcaagaccggcacaauagucuaucagagagggguguuacugccacagaaaguuuggugcgcaucuggaagguccaaggugauuaaagguucacuucccuugaucggcgaagccgauugucugcaugagaaguacgggggacuaaacaaaagcaagccguacuauacuggcgaacacgcuaaggccauugguaauugcccuaucugggucaaaaccccacucaagcuggcaaacgggacaaaauaccggcccccugcuaagcugcugaaagagcgcggcuuuuucggagccaucgcgggcuuuuuggaagggggaugggaagguaugauugccggcuggcacggguauacaagucauggagcacacggcguggcuguagccgcugaccucaagucuacccaggaggccauaaauaagaucacuaaaaaccuuaauuccuuaagcgaacuggagguuaagaaccuccaacgacuuucgggugcaauggacgaacugcauaaugagauuuuggagcuagaugaaaaaguggacgaucugagagccgacaccaucucuucccagauagagcucgcuguccugcuuucaaacgaagggauuaucaauagugaggaugaacaccuguuggcgcucgagaggaagcugaaaaagauguuaggccccagcgcaguggacaucggaaacggcuguuucgagacuaagcacaaaugcaaucagacgugccuggaucggauugccgcugggacauuuaacgccggagaguucucccuaccaaccuuugacucucucaauaucacugcagccagccugaacgaugacggucuugauaaucauaccauuuugcuguacuauucaacagcugccaguucccucgcagucacccugaugcuugcgauauucaucguguacaugguuagccgugacaacgugucuuguucaauuugccuguga

SEQ ID NO: 148801 - RNA, 1755 nt, Artificial Sequence; identical to SEQ ID NO: 148800
  derived and/or modified sequence opt3 from hemagglutinin__InfluenzaB__AFJ80722

SEQ ID NO: 148802 - RNA, 1755 nt, Artificial Sequence
  derived and/or modified sequence opt3 from hemagglutinin__InfluenzaB__AFJ80733
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcaugggaacgacuccuagcgcuaaagccuccauccuccaugaagugcgaccagucaccucuggcuguuuucccauuaugcacgaccguacaaagaucagacaacugccuaaucuucugagggguuaugagaacauacgguugucgacucagaaugugaucgaugcagaaaaggccccagggggacccuaccgccucggcaccucaggcagcugcccugacgcuacaaacaaaaguggguucuuugcaaccauggccugggcuguaccaaaggauaauaacaaaaaugccacgaacccgcugacuguugaggugcccuauauuuguacagaaggagaggaccagaucaccgucugggguuuccauuccgauaauaagacucagaugaaaaaccuguacggcgacucuaauccucaaaaguuuacaagcuccgcgaacggggugaccacgcacuaugugucacagauuggaggcuucccagaucagaccgaggacggugggcucccccagaguggaagaaucgucguugauuacaugaugcaaaagccuggcaaaacaggcacuauaguguaucagaggggaguauuacugccacagaagguguggugcgcaagcgggcggucuaaagucauuaaggguucccuucccuugaucggcgaagccgacugucugcaugagaaauacgggggacuaaacaagucaaaaccguacuauaccggcgaacacgcuaaggccauugguaauugcccuaucugggugaagacaccccucaaacuggcaaacgggacuaaguaccgcccuccagcuaaacuucugaaggagcgaggcuuuuucggagccaucgcgggcuuuuuggaagggggaugggaagguaugauugccggcuggcacggguauaccagccauggagcacacggcguugcuguggccgcugaccucaaaaguacacaggaggccauaaauaagaucaccaagaacuuaaauucucuguccgaacuggaggucaaaaaccuccaaagacuuagcggugcaauggaugaacugcauaaugagauuuuggagcuagacgaaaagguggaugaccugagggccgauacuaucucgucucagauagagcucgcuguacugcuuuccaacgaagggauuaucaauucagaggacgaacaccuguuggcgcucgagcggaaacugaagaaaauguuaggccccagugcaguugauaucggaaacggcuguuucgagacgaagcacaagugcaaucagacaugccuggaccguauugccgcugggaccuuuaacgccggagaguucagccuaccaacuuuugauucccucaauaucaccgcagccucucugaacgacgauggucuugacaaucauacaauuuugcuguacuauagcaccgcugccucaagucucgcagugacucugaugcuugcgauauucaucgucuacauggugucccgcgacaacgucagcuguucuauuugccuguga

SEQ ID NO: 148803 - RNA, 1758 nt, Artificial Sequence; identical to SEQ ID NO: 148530
  derived and/or modified sequence opt3 from hemagglutinin__InfluenzaB__AFJ80744

SEQ ID NO: 148804 - RNA, 1758 nt, Artificial Sequence; identical to SEQ ID NO: 148530
  derived and/or modified sequence opt3 from hemagglutinin__InfluenzaB__AFJ80755

SEQ ID NO: 148805 - RNA, 1758 nt, Artificial Sequence; identical to SEQ ID NO: 148530
  derived and/or modified sequence opt3 from hemagglutinin__InfluenzaB__AFJ80781

SEQ ID NO: 148806 - RNA, 1758 nt, Artificial Sequence; identical to SEQ ID NO: 148530
  derived and/or modified sequence opt3 from hemagglutinin__InfluenzaB__AFJ80792

SEQ ID NO: 148807 - RNA, 1758 nt, Artificial Sequence; identical to SEQ ID NO: 148530
  derived and/or modified sequence opt3 from hemagglutinin__InfluenzaB__AFJ80803

SEQ ID NO: 148808 - RNA, 1758 nt, Artificial Sequence; identical to SEQ ID NO: 148530
  derived and/or modified sequence opt3 from hemagglutinin__InfluenzaB__AFJ80814

SEQ ID NO: 148809 - RNA, 1758 nt, Artificial Sequence
  derived and/or modified sequence opt3 from hemagglutinin__InfluenzaB__AFJ80825
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccaaucacuucuggcuguuuucccauaaugcaugaucguaccaagaucagacaacugccuaaccuucugagggguuacgaacacauucgguugucgacacauaaugugaucaacgccgagaaugcaccagggggacccuauaaaauuggcacuucaggcagcugcccuaacguaaccaaugggaacggauucuuugccacaauggcuugggcaguuccaaagaaugacaacaauaaaaccgccacgaacagucucacuaucgaagugccguacauauguacagagggugaggaucagauuaccgucuggggcuuccacuccgacaacgaaacucagauggcuaagcuguauggggauucuaaaccccagaaguuuacaagcuccgccaauggagugaccacgcacuacgugucacaaaucggcgguuucccuaaccagaccgaggacgggggacugccacagaguggccgcauugucguugauuauauggugcaaaagagcggcaaaacagggacuaucaccuaccagagaggaauccucuuaccccagaagguauggugcgcgucugguagguccaaagugauuaagggcucacugccucuuauaggggaagcagacuguuugcaugagaaauauggaggccugaauaagagcaaaccauacuacacaggugagcacgccaaggcuaucgggaacugccccauuugggucaagacuccgcuaaaacucgccaauggcaccaaguaucggccucccgcaaaacugcuuaaggaacgcggauuuuucggcgcuaucgccggguuucuggagggagguugggaaggcaugauagcgggguggcauggauacacaagucacggcgcccacgguguggcaguugcugccgauuugaaaucuacccaggaggcuauuaacaagaucacuaagaaucucaacucccugagcgaauuagaggugaaaaaucugcagcgacucucgggggccauggacgagcuucauaacgaaauccuggaguuggaugaaaaggucgacgaccuaagagcagauacgauuucuucccaaaucgagcuggccgugcuccugucaaaugaaggcauuauaaacagugaggacgagcaccuucuggcuuuggaaaggaaacucaagaaaaugcugggaccaagcgcgguagagaucggcaauggguguuucgaaacaaagcauaagugcaaccagaccugcuuagaucggauugcagccggaacuuuugacgcuggugaguucucccugccuaccuuugauucucuaaauaucacagccgcaagccucaacgacgauggccuggacaaccacaccauccuuuuguauuacucaacugccgcuaguucccuggccguuacacucaugauugcaauauucguggucuauauggugagccgugauaaugucucuuguucaaucugccuguga

SEQ ID NO: 148810 - RNA, 1758 nt, Artificial Sequence; identical to SEQ ID NO: 148530
  derived and/or modified sequence opt3 from hemagglutinin__InfluenzaB__AFJ80836

SEQ ID NO: 148811 - RNA, 1758 nt, Artificial Sequence; identical to SEQ ID NO: 148598
  derived and/or modified sequence opt3 from hemagglutinin__InfluenzaB__AFJ80847

SEQ ID NO: 148812 - RNA, 1758 nt, Artificial Sequence; identical to SEQ ID NO: 148530
  derived and/or modified sequence opt3 from hemagglutinin__InfluenzaB__AFJ80858

SEQ ID NO: 148813 - RNA, 1758 nt, Artificial Sequence; identical to SEQ ID NO: 148530
  derived and/or modified sequence opt3 from hemagglutinin__InfluenzaB__AFJ80869

SEQ ID NO: 148814 - RNA, 1758 nt, Artificial Sequence; identical to SEQ ID NO: 148530
  derived and/or modified sequence opt3 from hemagglutinin__InfluenzaB__AFJ80880

SEQ ID NO: 148815 - RNA, 1758 nt, Artificial Sequence; identical to SEQ ID NO: 148581
  derived and/or modified sequence opt3 from hemagglutinin__InfluenzaB__AFJ80891

SEQ ID NO: 148816 - RNA, 1758 nt, Artificial Sequence; identical to SEQ ID NO: 148581
  derived and/or modified sequence opt3 from hemagglutinin__InfluenzaB__AFJ80902

SEQ ID NO: 148817 - RNA, 1758 nt, Artificial Sequence; identical to SEQ ID NO: 148530
  derived and/or modified sequence opt3 from hemagglutinin__InfluenzaB__AFJ80913

SEQ ID NO: 148818 - RNA, 1758 nt, Artificial Sequence
  derived and/or modified sequence opt3 from hemagglutinin__InfluenzaB__AFJ80924
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucugugcugagggugaggaucagauaacaguguggggcuuccacuccgacaacgaaacccagauggccaagcuguauggggauucuaaaccccagaaguuuacuagcuccgcgaauggagugacaacccacuacgucucacaaauuggcgguuucccuaaccagacggaggacgggggacugccacagaguggccgcaucguuguggauuauaugguacaaaagagcggcaaaaccgggacaauuacuuaccagagaggaauccucuuaccccagaagguguggugcgcaucugguagguccaaagucaucaagggcucacugccucuuauuggggaagccgacuguuugcaugagaaauauggaggccugaauaagagcaaaccauacuacaccggugagcacgcuaaggccauagggaacugccccaucugggugaagacaccgcuaaaacucgcaaauggcacuaaguaucggccucccgcuaaacugcuuaaggaacgcggauuuuucggcgccauugcgggguuucuggagggagguugggaaggcaugaucgccggguggcauggauacaccagucacggcgcacacgguguugcuguggccgcugauuugaaaucuacacaggaggccauaaacaagauuaccaagaaucucaacucccugagcgaauuagaggucaaaaaucugcagcgacucucgggggcaauggacgagcuucauaacgaaauccuggaguuggaugaaaagguggacgaccuaagagccgauacuaucucuucccaaauugagcuggcuguacuccugucaaaugaaggcaucauuaacagugaggacgagcaccuucuggcguuggaaaggaaacucaagaaaaugcugggaccaagcgcaguugagauaggcaauggguguuucgaaacgaagcauaagugcaaccagacaugcuuagaucggaucgccgcuggaaccuuugacgccggugaguucucccugccuacuuuugauucucuaaauauuaccgcagccagccucaacgacgauggccuggacaaccacacaauccuuuuguauuacucaaccgcugccaguucccuggcagugacucucaugaucgcgauuuucgucguguauauggucagccgugauaaugugucuuguucaauaugccuguga

SEQ ID NO: 148819 - RNA, 1758 nt, Artificial Sequence; identical to SEQ ID NO: 148581
  derived and/or modified sequence opt3 from hemagglutinin__InfluenzaB__AFJ80935

SEQ ID NO: 148820 - RNA, 1755 nt, Artificial Sequence; identical to SEQ ID NO: 148442
  derived and/or modified sequence opt3 from hemagglutinin__InfluenzaB__AFJ80946

SEQ ID NO: 148821 - RNA, 1758 nt, Artificial Sequence
  derived and/or modified sequence opt3 from hemagglutinin__InfluenzaB__AFJ80957
augaaggccaucauugugcugcucauggucgcuaccagcaacgcagacagaauaugcacaggcaucacuuccucuaauucaccccacguugugaaaacggccacccagggggagguaaacgugacaggagucauuccucuuacuaccacaccaaccaagagucauuucgcgaaucugaaagguacugaaacaaggggcaaguuguguccgaaaugcuuaaacuguaccgaucuggacguggcucuagggcggcccaagugcacgggaaauaucccuagcgcccgcguuuccauucuccacgaggugcgaccagucacuucuggcuguuuucccaucaugcaugaucguaccaagauaagacaacugccuaaccuucugagggguuacgaacacauccgguugucgacacauaaugugauuaacgcagagaaugccccagggggacccuauaaaaucggcacuucaggcagcugcccuaacguaaccaaugggaacggauucuuugcuacaauggcaugggccguuccaaagaaugacaacaauaaaaccgcuacgaacagucucacuauugaagugccguacaucuguacagagggugaggaucagauaaccgucuggggcuuccacuccgacaacgaaacucagauggccaagcuguauggggauucuaaaccccagaaguuuacaagcuccgcgaauggagugaccacgcacuacgugucacaaauuggcgguuucccuaaccagaccgaggacgggggacugccacagaguggccgcaucgucguugauuauauggugcaaaagagcggcaaaacagggacuauuaccuaccagagaggaauccucuuaccccagaagguauggugcgcaucugguagguccaaagugaucaagggcucacugccucuuauuggggaagccgacuguuugcaugagaaauauggaggccugaauaagagcaaaccauacuacacaggugagcacgcuaaggccauagggaacugccccaucugggucaagacuccgcuaaaacucgcaaauggcaccaaguaucggccucccgcuaaacugcuuaaggaacgcggauuuuucggcgccauugcgggguuucuggagggagguugggaaggcaugaucgccggguggcauggauacacaagucacggcgcacacgguguggcuguugccgcugauuugaaaucuacccaggaggccauaaacaagauuacuaagaaucucaacucccugagcgaauuagaggugaaaaaucugcagcgacucucgggggcaauggacgagcuucauaacgaaauccuggaguuggaugaaaaggucgacgaccuaagagccgauacgaucucuucccaaauugagcuggcugugcuccugucaaaugaaggcaucauuaacagugaggacgagcaccuucuggcguuggaaaggaaacucaagaaaaugcugggaccaagcgcaguagagauaggcaauggguguuucgaaacaaagcauaagugcaaccagaccugcuuagaucggaucgccgcuggaacuuuuaaugccggugaguucucccugccuaccuuugacucucuaaacauuacagcagccagccucaacgaugacggccuggauaaucacaccauccuuuuguauuacucaacugcugccaguucccuggcaguuacacucaugaucgcgauuuucguggucuauauggugagccgugacaacgucucuuguucaauaugccuguga

SEQ ID NO: 148822 - RNA, 1755 nt, Artificial Sequence; identical to SEQ ID NO: 148442
  derived and/or modified sequence opt3 from hemagglutinin__InfluenzaB__AFJ80968

SEQ ID NO: 148823 - RNA, 1755 nt, Artificial Sequence; identical to SEQ ID NO: 148442
  derived and/or modified sequence opt3 from hemagglutinin__InfluenzaB__AFJ80979

SEQ ID NO: 148824 - RNA, 1755 nt, Artificial Sequence
  derived and/or modified sequence opt3 from hemagglutinin__InfluenzaB__AFJ80990
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcugaagccuccauccuccaugagguccgaccagugaccucuggcuguuuucccauuaugcacgaccguacaaaaaucagacaacugccuaaucuucugagggguuaugaaaacauacgguugucgacucagaauguaaucgaugcagagaaggccccagggggacccuaccgccucggcaccucaggcagcugcccuaacgcuacaaauaagaguggguucuuugcaaccauggccugggcuguuccaaaagacaacaauaagaacgccacgaauccgcugacuguggaaguccccuauauuuguacagagggagaggaucagaucaccgugugggguuuccauuccgacaacaaaacucagaugaagaaucuguacggcgauucuaacccucaaaaauuuacaagcuccgcgaacggggugaccacgcacuaugucucacagauuggaggcuucccagaccagaccgaagauggugggcucccccagaguggaagaaucguuguggacuacaugaugcaaaagccuggcaagacaggcacuauaguauaucagaggggaguguuacugccacagaaagucuggugcgcaagcgggcggucuaaggugauuaaagguucccuucccuugaucggcgaggccgauugucugcaugaaaaguacgggggacuaaauaaaucaaagccguacuauaccggcgagcacgcuaaagccauugguaacugcccuaucuggguuaagacaccccucaagcuggcaaaugggacuaaauaccgcccuccagcuaaacuucugaaggagcgaggcuuuuucggagccaucgcgggcuuuuuggaagggggaugggaggguaugauugccggcuggcacggguauaccagccauggagcacacggcguggcugucgccgcugaccucaagaguacacaggaagccauaaacaaaaucaccaagaaucugaacucuuuauccgagcuggaagugaagaaucuccaaagacuuagcggugcaauggacgagcugcauaacgagauuuuggaacuagaugagaaaguagacgaucugagggccgacacuaucucgucucagauagaacucgcuguucugcuuuccaaugaggggauuaucaacucagaagaugagcaccuguuggcgcucgagcggaagcugaaaaagauguuaggccccagugcaguggacaucggaaauggcuguuucgaaacgaaacacaagugcaaccagacaugccuggaucguauugccgcugggaccuuuaaugccggagaguucagccuaccaacuuuugacucccucaacaucaccgcagccucucugaaugaugacggucuugauaaccauacaauuuugcuguacuauagcaccgcugccucaagucucgcagucacucugaugcuugcgauauucaucguguacauggucucccgcgacaacgugagcuguucuauuugccuguga

SEQ ID NO: 148825 - RNA, 1755 nt, Artificial Sequence; identical to SEQ ID NO: 148442
  derived and/or modified sequence opt3 from hemagglutinin__InfluenzaB__AFJ81001

SEQ ID NO: 148826 - RNA, 1755 nt, Artificial Sequence; identical to SEQ ID NO: 148442
  derived and/or modified sequence opt3 from hemagglutinin__InfluenzaB__AFJ84360

SEQ ID NO: 148827 - RNA, 1758 nt, Artificial Sequence; identical to SEQ ID NO: 148530
  derived and/or modified sequence opt3 from hemagglutinin__InfluenzaB__AFJ90395

SEQ ID NO: 148828 - RNA, 1755 nt, Artificial Sequence; identical to SEQ ID NO: 148442
  derived and/or modified sequence opt3 from hemagglutinin__InfluenzaB__AFJ90406

SEQ ID NO: 148829 - RNA, 1755 nt, Artificial Sequence; identical to SEQ ID NO: 148442
  derived and/or modified sequence opt3 from hemagglutinin__InfluenzaB__AFJ90417

SEQ ID NO: 148830 - RNA, 1755 nt, Artificial Sequence; identical to SEQ ID NO: 148442
  derived and/or modified sequence opt3 from hemagglutinin__InfluenzaB__AFJ90428

SEQ ID NO: 148831 - RNA, 1755 nt, Artificial Sequence; identical to SEQ ID NO: 148442
  derived and/or modified sequence opt3 from hemagglutinin__InfluenzaB__AFJ90450

SEQ ID NO: 148832 - RNA, 1755 nt, Artificial Sequence; identical to SEQ ID NO: 148442
  derived and/or modified sequence opt3 from hemagglutinin__InfluenzaB__AFJ91038

SEQ ID NO: 148833 - RNA, 1755 nt, Artificial Sequence
  derived and/or modified sequence opt3 from hemagglutinin__InfluenzaB__AFJ91049
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaucaccccaacaaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauucuccaugaaguccgaccagugacuucuggcuguuuucccaucaugcacgaccguaccaagauaagacaacuggcaaaucuucugagggguuaugagaacauccgguugucgacacagaauguaauugaugccgaaaaggcuccugggggaccauaccgccucggcacuucaggcagcugccccaacgcaaccaguaaauccggguucuuugccacaauggcuugggccguuccuaaggacaauaacaaaaaugcgaccaacccacugacgguggaggucccguauaucuguacugaaggagaggaucagauuacagugugggguuuccauucugacaauaagacccagaugaaaaaccuguacggcgauagcaauccccaaaaguuuacuuccucagcaaacggggugacaacccacuaugucagucagaucggaggcuucccugaccagacggaggauggugggcucccacagagcggaagaauaguuguggacuacaugaugcaaaagcccggcaaaaccggcacaauuguauaucagcgcgggguguuacugccucagaaggucuggugcgccucuggacgguccaaagugaucaaggguucacuuccauugauuggcgaagcugauugucugcaugagaaauacgggggacuaaacaagagcaaacccuacuauacuggcgaacacgccaaggcaaucgguaauugcccgaucuggguuaagaccccucucaaacuggcuaacgggacaaaguacaggcccccagccaaacuucugaaggagcgaggcuuuuucggagcgauugccggcuuuuuggaagggggaugggaagguaugauagcaggcuggcacggguauacuucccauggagcucacggcguggccgucgcugccgaccucaaaucuacccaggaggcaaucaauaagauuacaaagaaccugaauaguuuaagcgaacuggaggugaaaaaccuccaaagacuuucgggugccauggacgaacugcauaaugagaucuuggagcuagaugaaaagguagacgaucugagggcugacaccauaucuucccagauugagcucgcgguucugcuuucaaacgaagggaucaucaauagugaggaugaacaccuguuggcacucgagcggaaacugaagaaaauguuaggcccuagcgccguggacauuggaaacggcuguuucgagacuaagcacaagugcaaucagacgugccuggaucguaucgcugccgggacauuuaacgcaggagaguucucccuacccaccuuugacucucucaauauuacugccgcuagccugaacgaugacggucuugauaaucauaccauauugcuguacuauucaacagccgcaaguucccucgcggucacccugaugcuugcuaucuucauuguguacauggucagccgcgacaacgugucuuguucaaucugccuguga

SEQ ID NO: 148834 - RNA, 1758 nt, Artificial Sequence
  derived and/or modified sequence opt3 from hemagglutinin__InfluenzaB__AFJ91060
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgcggugcuuaaacuguaccgaucuggacguugcgcuagggcgccccaaaugcacgggaaauaucccuagcgcucgaguguccauucuccacgagguccguccagugacuucuggcuguuuucccaucaugcaugauagaaccaagauaaggcaacugccuaaccuucugcgggguuacgaacacauccgcuugucgacacauaauguaauuaacgccgagaaugcaccagggggacccuauaagaucggcacuucaggcagcugcccuaacguuaccaaugggaacggauucuuugccacaauggcuugggcagugccaaagaaugacaacaauaagaccgccacgaacagucucacuauugaagucccguacaucuguacagagggugaggaucagauaaccguguggggcuuccacuccgacaacgaagcucagauggccaaacuguauggggauucuaagccccagaaauuuacuagcuccgcgaauggagugacaacccacuacgucucacaaauuggcgguuucccuaaccagacggaggacgggggacugccacagaguggcagaaucguuguggauuauaugguacagaaaagcggcaagaccgggacaauuacuuaccaaaggggaauccucuuaccccagaaaguguggugcgcaucuggucgguccaaggucaucaaaggcucacugccucuuauuggggaagccgacuguuugcaugagaaguauggaggccugaauaaaagcaagccauacuacaccggugagcacgcuaaagccauagggaacugccccaucugggugaagacaccgcuaaagcucgcaaauggcacuaaauaucgcccucccgcuaagcugcuuaaagaacgaggauuuuucggcgccauugcgggguuucuggagggagguugggaaggcaugaucgccggguggcauggauacaccagucacggcgcacacgguguugcuguggccgcugauuugaagucuacacaggaggccauaaacaaaauuaccaagaaucucaacucccugagcgaauuagaggucaagaaucugcagagacucucgggggcaauggacgagcuucauaacgaaauccuggaguuggaugaaaaaguggacgaccuaagggccgauacuaucucuucccaaauugagcuggcuguacuccugucaaaugaaggcaucauuaacagugaggacgagcaccuucuggcguuggaacggaagcucaaaaagaugcugggaccaagcgcaguugagauaggcaauggguguuucgaaacgaaacauaagugcaaccagacaugcuuagaucguaucgccgcuggaaccuuugacgccggugaguucucccugccuacuuuugauucucuaaauauuaccgcagccagccucaacgacgauggccuggacaaccacacaauccuuuuguauuacucaaccgcugccaguucccuggcagugacucucaugaucgcgauuuucgucguguauauggucagccgcgauaaugugucuuguucaauaugccuguga

SEQ ID NO: 148835 - RNA, 1755 nt, Artificial Sequence; identical to SEQ ID NO: 148442
  derived and/or modified sequence opt3 from hemagglutinin__InfluenzaB__AFJ91071

SEQ ID NO: 148836 - RNA, 1755 nt, Artificial Sequence
  derived and/or modified sequence opt3 from hemagglutinin__InfluenzaB__AFJ91082
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaacugcauaacgagaucuuggagcuagacgaaaagguagaugaccugagggccgauacuauaucgucucagauugagcucgcuguucugcuuuccaaugaagguaucaucaacucagaggacgaacaccuguuggcgcucgagcggaaacugaagaaaauguuagggcccagugcaguggauauuggcaauggauguuucgagacgaagcacaagugcaaccagacaugccuggaccguaucgccgcuggcaccuuuaaugccggggaguucagccuaccaacuuuugauucccucaacauuaccgcagccucucugaaugacgauggacuugacaaccauacaauauugcuguauuacagcaccgcugccucaagucucgcagucacucugaugcuugcgaucuucauuguguauauggucucccgcgacaaugugagcuguucuaucugccuguga

SEQ ID NO: 148837 - RNA, 1755 nt, Artificial Sequence; identical to SEQ ID NO: 148836
  derived and/or modified sequence opt3 from hemagglutinin__InfluenzaB__AFJ91093

SEQ ID NO: 148838 - RNA, 1755 nt, Artificial Sequence; identical to SEQ ID NO: 148836
  derived and/or modified sequence opt3 from hemagglutinin__InfluenzaB__AFJ91104

SEQ ID NO: 148839 - RNA, 1755 nt, Artificial Sequence; identical to SEQ ID NO: 148836
  derived and/or modified sequence opt3 from hemagglutinin__InfluenzaB__AFJ91115

SEQ ID NO: 148840 - RNA, 1758 nt, Artificial Sequence
  derived and/or modified sequence opt3 from hemagglutinin__InfluenzaB__AFJ91704
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaagggauucuuugccacaauggcuugggcagugccgaaaaacgacaauaacaagaccgccacgaauagucucacuauugaagucccauacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcuauaaauaagauuacuaaaaaccucaauucccugagcgaauuagaggucaagaaccugcagcgacucucgggggccauggacgagcuucauaaugaaauccuggaguuggaugaaaaaguggacgaccuaagagcagauacgaucucuucccaaauugagcuggccguacuccugucaaacgaaggcaucauuaauagugaggacgagcaccuucuggcuuuggaaaggaagcucaaaaagaugcugggaccaagcgcgguugagauaggcaacggguguuucgaaacaaagcauaaaugcaaucagaccugcuuagaucggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgugauaacgugucuuguucaauaugccuguga

SEQ ID NO: 148841 - RNA, 1755 nt, Artificial Sequence
  derived and/or modified sequence opt3 from hemagglutinin__InfluenzaB__AFK09797
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaucaagaguuacuucgccaaucugaaagguaccaagacuaggggcaaauuguguccggauugcuuaaacuguacagaccuggauguugcgcuagggcggcccaugugcgugggaaccacgccuagcgcuaaggccuccauucuccaugaaguccgcccagugacuucuggcuguuuucccaucaugcacgaccgaaccaagauacgucaacugccuaaucuucugagagguuaugagaacaucagguugucgacacagaauguaauugaugcagaaaaagccccagggggacccuaccggcucggcacuucaggcagcugcccuaacgcuaccaguaaguccggguucuuugcaacaauggccugggcuguuccaaaagacaauaacaagaaugccaccaacccgcugacgguggagguccccuauguguguacugaaggagaggaucagaucacagugugggguuuccauucugacaauaaaaaccagaugaagaaucuguacggcgauagcaacccucaaaaguuuaccuccucagcgaacggggucacuacacacuauguuagucagauuggaggcuucccagaccagaccgaggauggugggcucccccagagcggacgcaucgugguagacuacauggugcaaaaaccuggcaagacgggcaccauagucuaucagagagggguguuacugccacagaaaguuuggugcgcaucuggaagguccaaggugauuaaagguucacuucccuugaucggcgaagccgauugucugcaugagaaguacgggggacuaaauaaaagcaagccguacuauacaggcgaacacgcuaaggccauugguaacugcccuaucugggucaaaacuccccucaagcuggcaaaugggaccaaauaccggccuccagcuaaacuucugaaggagcgcggcuuuuucggagccaucgcgggcuuuuuggaagggggaugggaagguaugauugccggcuggcacggguauacaagucauggagcacacggcguggcuguagccgcugaccucaagucuacucaggaggccauaaacaagaucaccaaaaaucugaacuccuuaagcgaacuggagguuaagaaucuccaacgacuuucgggugcaauggacgaacugcauaacgagauuuuggagcuagaugaaaaaguggacgaucugagagccgacacaaucucuucccagauagagcucgcuguccugcuuucaaaugaagggauuaucaacagugaggaugaacaccuguuggcgcucgagaggaagcugaaaaagauguuaggccccagcgcaguggacaucggaaauggcuguuucgagaccaagcacaaaugcaaccagacuugccuggaucggauugccgcugggacguuuaaugccggagaguucucccuaccaacauuugacucucucaacaucaccgcagccagccugaaugaugacggucuugauaaccauacuauuuugcuguacuauucaaccgcugccaguucccucgcagucacacugaugcuugcgauauucaucguguacaugguuagccgugacaacgugucuuguucaauuugccuguga

SEQ ID NO: 148842 - RNA, 1755 nt, Artificial Sequence; identical to SEQ ID NO: 148836
  derived and/or modified sequence opt3 from hemagglutinin__InfluenzaB__AFN54654

SEQ ID NO: 148843 - RNA, 1755 nt, Artificial Sequence; identical to SEQ ID NO: 148583
  derived and/or modified sequence opt3 from hemagglutinin__InfluenzaB__AFN54665

SEQ ID NO: 148844 - RNA, 1755 nt, Artificial Sequence; identical to SEQ ID NO: 148583
  derived and/or modified sequence opt3 from hemagglutinin__InfluenzaB__AFN54676

SEQ ID NO: 148845 - RNA, 1755 nt, Artificial Sequence; identical to SEQ ID NO: 148836
  derived and/or modified sequence opt3 from hemagglutinin__InfluenzaB__AFN54687

SEQ ID NO: 148846 - RNA, 1755 nt, Artificial Sequence
  derived and/or modified sequence opt3 from hemagglutinin__InfluenzaB__AFN54698
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuaccagcuucgcgaauggggugacaacgcacuacgucucccagaucggagacuuuccagaucagaccgaggacggcggucucccccagucagggagaauaguuguggauuauaugaugcaaaagccuggaaaaacaggcacuauuguauaccagaggggcguguuacugccacagaaggucuggugcgcaagugggcggagcaaagugaucaagggaucucuucccuugauuggugaagccgacugucugcaugagaaauacggcgggcuaaacaaguccaaaccguauuacaccggagaacacgcuaaggccaucggcaacugcccuaucuggguuaagacaccccucaaacuggcaaaugguacuaaguaucgcccuccagcuaaacuucugaaggagcgaggguucuuuggcgccauugcgggauucuuggagggcgggugggaaggaaugauagccgguuggcacggcuacaccucacauggggcacacggaguggcugucgccgcugaccucaaaagcacacaggaggccaucaacaagauuaccaagaaucugaacaguuuaucugaacuggaggugaaaaaucuccaaagacuuuccggcgcaauggaugaacugcauaacgagaucuuggagcuagacgaaaagguagaugaccugagggccgauacuauaagcucgcagauugagcucgcuguucugcuuucuaaugaagguaucaucaacuccgaggacgaacaccuguuggcgcucgagcggaaacugaagaaaauguuagggcccucagcaguggauauuggcaauggauguuuugagacgaagcacaagugcaaccagacaugccuggaccguaucgccgcuggcaccuucaaugccggggaauuuagucuaccaacuuucgauagccucaacauuaccgcagccucccugaaugacgauggacuugacaaccauacaauauugcuguauuacucuaccgcugccagcucacucgcagucacucugaugcuugcgaucuucauuguguauauggucagucgcgacaauguguccuguagcaucugccuguga

SEQ ID NO: 148847 - RNA, 1755 nt, Artificial Sequence; identical to SEQ ID NO: 148836
  derived and/or modified sequence opt3 from hemagglutinin__InfluenzaB__AFN54709

SEQ ID NO: 148848 - RNA, 1755 nt, Artificial Sequence; identical to SEQ ID NO: 148836
  derived and/or modified sequence opt3 from hemagglutinin__InfluenzaB__AFN54720

SEQ ID NO: 148849 - RNA, 1755 nt, Artificial Sequence; identical to SEQ ID NO: 148836
  derived and/or modified sequence opt3 from hemagglutinin__InfluenzaB__AFN54731

SEQ ID NO: 148850 - RNA, 1755 nt, Artificial Sequence; identical to SEQ ID NO: 148836
  derived and/or modified sequence opt3 from hemagglutinin__InfluenzaB__AFN54742

SEQ ID NO: 148851 - RNA, 1755 nt, Artificial Sequence; identical to SEQ ID NO: 148836
  derived and/or modified sequence opt3 from hemagglutinin__InfluenzaB__AFN54753

SEQ ID NO: 148852 - RNA, 1755 nt, Artificial Sequence; identical to SEQ ID NO: 148836
  derived and/or modified sequence opt3 from hemagglutinin__InfluenzaB__AFN54764

SEQ ID NO: 148853 - RNA, 1755 nt, Artificial Sequence; identical to SEQ ID NO: 148836
  derived and/or modified sequence opt3 from hemagglutinin__InfluenzaB__AFN54775

SEQ ID NO: 148854 - RNA, 1755 nt, Artificial Sequence; identical to SEQ ID NO: 148836
  derived and/or modified sequence opt3 from hemagglutinin__InfluenzaB__AFN54786

SEQ ID NO: 148855 - RNA, 1755 nt, Artificial Sequence; identical to SEQ ID NO: 148836
  derived and/or modified sequence opt3 from hemagglutinin__InfluenzaB__AFN54797

SEQ ID NO: 148856 - RNA, 1755 nt, Artificial Sequence; identical to SEQ ID NO: 148836
  derived and/or modified sequence opt3 from hemagglutinin__InfluenzaB__AFN54808

SEQ ID NO: 148857 - RNA, 1755 nt, Artificial Sequence; identical to SEQ ID NO: 148583
  derived and/or modified sequence opt3 from hemagglutinin__InfluenzaB__AFN54819

SEQ ID NO: 148858 - RNA, 1755 nt, Artificial Sequence; identical to SEQ ID NO: 148836
  derived and/or modified sequence opt3 from hemagglutinin__InfluenzaB__AFN54830

SEQ ID NO: 148859 - RNA, 1755 nt, Artificial Sequence; identical to SEQ ID NO: 148836
  derived and/or modified sequence opt3 from hemagglutinin__InfluenzaB__AFN54841

SEQ ID NO: 148860 - RNA, 1755 nt, Artificial Sequence; identical to SEQ ID NO: 148836
  derived and/or modified sequence opt3 from hemagglutinin__InfluenzaB__AFN54852

SEQ ID NO: 148861 - RNA, 1755 nt, Artificial Sequence; identical to SEQ ID NO: 148836
  derived and/or modified sequence opt3 from hemagglutinin__InfluenzaB__AFN54863

SEQ ID NO: 148862 - RNA, 1758 nt, Artificial Sequence
  derived and/or modified sequence opt3 from hemagglutinin__InfluenzaB__AFU34595
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuaucgcgauuccaagccacagaaauuuacaucuagcgccaacggggugaccacgcacuacgucucccaaauuggaggcuuccccaaccagaccgaggacggugggcugccucagucaggaagaaucguuguggauuauaugguacagaagaguggcaaaacaggcacuauuaccuaccaaagggggauccugcucccacagaagguguggugcgcgagcggacggucuaaagucaucaaggguuccuuaccccugauuggcgaagcagacugucuucaugagaaauaugggggauugaauaagucaaagccguacuacacaggcgagcacgccaaagcuauagguaacugcccuaucugggugaagacuccccugaaacuagccaaugggaccaaguaucgcccaccuacaaaacuccugaaggaacgaggcuuuuucggagcaauugcuggcuuucuugaagggggaugggaggguaugaucgccggcuggcauggguacaccagccacggagcgcacggcguugccguggcagcugaucugaagaguacucaggaggccauaaacaaaauuacgaagaauuugaacucucucuccgaacuggaggucaaaaauuuacagagacugagcggugcuauggacgagcuccauaacgaaauccuugagcuggaugaaaagguggacgacuugagggccgauacaaucucgucucaaauugagcuagcaguacugcucuccaaugaagggaucauuaacucagaggacgagcaucugcuugcccuggaacggaaauugaagaagaugcucggccccagugcuguugagauaggaaauggcuguuucgaaaccaaacacaagugcaaccagacuugccuggaucguaucgcggcagggaccuuugacgccggagaguucagcuuaccaacauuugauucccugaauauuaccgcugccucucuaaacgacgauggucucgacaaucacacuauccugcuuuauuacagcacagcagccucaaguuuggcugugacgcugaugaucgccauuuucgucguguauauggucucccgcgauaacgugagcuguucuauaugccucuga

SEQ ID NO: 148863 - RNA, 1758 nt, Artificial Sequence
  derived and/or modified sequence opt3 from hemagglutinin__InfluenzaB__AFU34606
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggaucggccuaagugcacggggaagaucccaagcgcucgcguguccauucuacacgagguccgacucgugacuucuggauguuuucccaucaugcaugaccguaccaaaauaagacaacugccuaaucuucugaggggcuacgaacacauccgguugucgacacauaacguaauuaaugccgagaacgcaccaggugggcccuauaagaucggaacuucaggcagcugcccuaauguuaccaacggcaauggguucuuugccacaauggcuugggcagugccgaaaaacgauaagaauaaaaccgccacgaacccacucacuauugaaguccccuacaucuguacagagggagaggaccagauaaccgugugggguuuccacagugaugacgaaacucagauggcuaagcuguauggcgauuccaagccucagaaauuuacaucuagcgccaauggggugaccacgcacuacgucucccaaauuggaggcuucccaaaccagaccgaggacggugggcugccccagucaggacgcaucguuguggauuauaugguacagaagaguggcaaaacaggcacuauuaccuaccaaagagggauccucuuaccucagaagguguggugcgcgagcggaaggucuaaagucaucaaggguucccugccacuuauuggcgaagcagacuguuugcaugagaaauaugggggacugaacaagucaaagcccuacuacacaggcgagcacgccaaagcuauagguaauugcccgaucugggugaagacuccucuaaaacucgccaacgggaccaaguaucggcccccagcaaaacugcuuaaggaacgcggcuuuuucggagcuauugccggcuuucuggaagggggaugggaggguaugaucgcgggcuggcauggguacacaagccacggagcccacggcguugcaguggcugccgauuugaagaguacccaggaggcuauaaauaaaauuacuaagaaccucaauucucuguccgaauuagaggucaaaaaccugcagcgacucagcggugccauggacgagcuucauaaugaaauccuggaguuggacgaaaagguggaugaccuaagagcagauacgaucucgucucaaauugagcuggccguacuccuguccaacgaagggaucauuaauucagaggacgagcaccuucuggcuuuggaaaggaaacucaagaagaugcugggcccuagugcgguugagauaggaaacggcuguuucgaaacaaaacauaagugcaaucagaccugcuuagaucggaucgcagccgggacuuuugacgcuggagaguucagccugcccaccuuugauucccuaaacauuacagccgcaucucucaaugacgauggucuggacaaccacaccauccuuuuguauuacagcacugccgcuucaagucuggccgugacacucaugaucgcaauuuucgucguguauauggucucccgugauaaugugagcuguucuauaugccuguga

SEQ ID NO: 148864 - RNA, 1758 nt, Artificial Sequence; identical to SEQ ID NO: 148772
  derived and/or modified sequence opt3 from hemagglutinin__InfluenzaB__AFU34617

SEQ ID NO: 148865 - RNA, 1758 nt, Artificial Sequence
  derived and/or modified sequence opt3 from hemagglutinin__InfluenzaB__AFU34628
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacgaugaaacucagauggcuaagcucuauggggacuccaagccacagaaauuuacaucuagcgccaauggagugaccacgcacuacgucucccaaauuggcgguuuccccaaccagaccgaggaugggggacugccucagucaggccgcaucguuguggacuauaugguacagaagaguggcaaaacagggacuauuaccuaccaaagaggaauccugcucccacagaagguguggugcgcgagcgguaggucuaaagucaucaagggcuccuuaccccugauuggggaagcagauugucuucaugagaaauauggaggcuugaacaagucaaagccguacuacacaggugagcacgccaaagcuauagggaauugcccuaucugggugaagacuccccugaaacuagccaacggcaccaaguaucggccuccagcaaaacuccugaaggaacgcggauuucuuggcgcuauugccggguuccuggagggagguuggaagggcaugaucgcgggguggcauggauacacaagccacggcgcccacgguguugcaguggcugccgacuugaaaaguacccaggaagcuauaaauaagauuacuaaaaaccucaauucucuguccgaguuagaagucaagaaccugcagcgacucagcggggccauggaugagcuucauaaugagauccuggaauuggacgagaaaguggacgaucuaagagcagacacgaucucgucucaaauugaacuggccguacuccuguccaacgagggcaucauuaauucagaagaugagcaccuucuggcuuuggagaggaagcucaagaaaaugcugggacccagugcgguugaaauaggcaacggguguuuugagacaaagcauaaaugcaaucagaccugcuuagaccggaucgcagccggaacuuucgaugcuggugaauuuagccugccaaccuucgacucccuaaacauuacagccgcaucucucaaugaugacggccuggauaaccacaccauccuuuuguauuacagcacugccgcuucaagucuggccgugacacucaugaucgcaauuuuugucguguauauggucucccgugacaaugugagcuguucuauaugccuguga

SEQ ID NO: 148866 - RNA, 1758 nt, Artificial Sequence; identical to SEQ ID NO: 148624
  derived and/or modified sequence opt3 from hemagglutinin__InfluenzaB__AFU34639

SEQ ID NO: 148867 - RNA, 1758 nt, Artificial Sequence; identical to SEQ ID NO: 148661
  derived and/or modified sequence opt3 from hemagglutinin__InfluenzaB__AGB08299

SEQ ID NO: 148868 - RNA, 1758 nt, Artificial Sequence; identical to SEQ ID NO: 148661
  derived and/or modified sequence opt3 from hemagglutinin__InfluenzaB__AGB08300

SEQ ID NO: 148869 - RNA, 1755 nt, Artificial Sequence
  derived and/or modified sequence opt3 from hemagglutinin__InfluenzaB__AGB97259
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaauaaaacucagaugaagucucuguauggcgauagcaacccucaaaaguuuacauccucagcgaauggggugaccacgcacuacgucagucagaucggagacuucccagaucagaccgaggacggcggucucccccagagcgggagaauaguuguggauuauaugaugcaaaaaccuggaaagacaggcacuauuguauaccagaggggcguguuacugccacagaaagucuggugcgcaucugggcgguccaaggugaucaaaggaucacuucccuugauuggugaagccgacugucugcaugaggaauacggcgggcuaaacaagagcaaaccguauuacaccggaaagcacgcuaaggccaucggcaauugcccuaucuggguuaaaacaccccucaagcuggcaaacgguacuaaauaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaagucuacacaggaggccaucaacaagauuaccaaaaaucugaacuccuuaagcgaacuggaggugaagaaucuccaaagacuuucgggcgcaauggaugaacugcauaacgagaucuuggagcuagacgaaaaaguagaugaccugagggccgauacuauaucuucccagauugagcucgcuguucugcuuucaaaugaagguaucaucaacagugaggacgaacaccuguuggcgcucgagcggaagcugaaaaagauguuagggcccagcgcaguggauauuggcaauggauguuucgagacgaagcacaaaugcaaccagacaugccuggaccguaucgccgcuggcaccuuuaaugccggggaguucucccuaccaacuuuugauucucucaacauuaccgcagccagccugaaugacgauggacuugacaaccauacaauauugcuguauuacucaaccgcugccaguucccucgcagucacucugaugcuugcgaucuucauuguguauaucgucagccgcgacaaugugucuuguucaaucugccuguga

SEQ ID NO: 148870 - RNA, 1755 nt, Artificial Sequence
  derived and/or modified sequence opt3 from hemagglutinin__InfluenzaB__AGB97265
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagcccacggcguggcugucgccgcagaccucaagucuacccaggaggccauaaauaagaucacuaaaaaccuuaauuccuuaagcgaacuggaggugaagaaccuccaacgacuuucgggugcuauggacgaacugcauaaugagauuuuggagcuagaugaaaaaguagacgaucugagagcggacaccaucucuucccagauagagcucgcaguucugcuuucaaacgaagggauuaucaauagugaggaugaacaccuguuggcccucgagaggaagcugaaaaagauguuaggcccuagcgcuguggacaucggaaacggcuguuucgagacuaagcacaaaugcaaucagacgugccuggaucggauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgugacaacgugucuuguucaauuugccuguga

SEQ ID NO: 148871 - RNA, 1755 nt, Artificial Sequence; identical to SEQ ID NO: 148870
  derived and/or modified sequence opt3 from hemagglutinin__InfluenzaB__AGF44878

SEQ ID NO: 148872 - RNA, 1755 nt, Artificial Sequence; identical to SEQ ID NO: 148870
  derived and/or modified sequence opt3 from hemagglutinin__InfluenzaB__AGF44879

SEQ ID NO: 148873 - RNA, 1755 nt, Artificial Sequence
  derived and/or modified sequence opt3 from hemagglutinin__InfluenzaB__AGF44881
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaagguaugauugccggcuggcacggguauacaagucauggagcucacggcguggccgucgcagccgaccucaagucuacucaggaggcuauaaauaagaucaccaaaaaccuuaauuccuuaagcgaacuggaggugaagaaccuccaacgacuuucgggugcgauggacgaacugcauaaugagauuuuggagcuagaugaaaaaguagacgaucugagagcagacacaaucucuucccagauagagcucgccguucugcuuucaaacgaagggauuaucaauagugaggaugaacaccuguuggcucucgagaggaagcugaaaaagauguuaggcccuagcgccguggacaucggaaacggcuguuucgagaccaagcacaaaugcaaucagacuugccuggaucggauugcagccgggacguuuaacgcuggagaguucucccuacccacauuugacucucucaauaucaccgccgcaagccugaacgaugacggucuugauaaucauacuauuuugcuguacuauucaaccgcggcuaguucccucgccgucauacugaugcuugcaaucuucauuguguacauggucagccgugacaacgugucuuguucaaucugccuguga

SEQ ID NO: 148874 - RNA, 1755 nt, Artificial Sequence
  derived and/or modified sequence opt3 from hemagglutinin__InfluenzaB__AGF44882
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaaaguccaaagugauuaaggguucacuuccauugaucggcgaagccgauugucugcaugagaaauacgggggacuaaacaagagcaagcccuacuauacuggcgaacacgcaaaagcuauugguaauugcccgaucuggguuaagaccccucucaaacuggccaacgggacaaaguacaggcccccagcgaaacuucugaaggagcggggcuuuuucggagccaucgcaggcuuuuuggaagggggaugggaagguaugauugcuggcuggcacggguauacuucccauggagcccacggcguggcugucgccgcagaccucaagucuacccaggaggccauaaauaaaaucacaaagaaccugaauaguuuaagcgaacuggaggugaaaaaccuccaacgccuuucgggugcuauggacgaacugcauaaugagauuuuggagcuagaugaaaagguagacgaucugcgagcggacaccaucucuucccagauagagcucgcaguucugcuuucaaacgaagggauuaucaauagugaggaugaacaccuguuggcccucgagagaaaacugaagaagauguuaggcccuagcgcuguggacaucggaaacggcuguuucgagacuaaacacaagugcaaucagacgugccuggauaggauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgggacaacgugucuuguucaauuugccuguga

SEQ ID NO: 148875 - RNA, 1755 nt, Artificial Sequence; identical to SEQ ID NO: 148870
  derived and/or modified sequence opt3 from hemagglutinin__InfluenzaB__AGF44883

SEQ ID NO: 148876 - RNA, 1755 nt, Artificial Sequence; identical to SEQ ID NO: 148870
  derived and/or modified sequence opt3 from hemagglutinin__InfluenzaB__AGF44884

SEQ ID NO: 148877 - RNA, 1755 nt, Artificial Sequence; identical to SEQ ID NO: 148870
  derived and/or modified sequence opt3 from hemagglutinin__InfluenzaB__AGF44886

SEQ ID NO: 148878 - RNA, 1755 nt, Artificial Sequence; identical to SEQ ID NO: 148870
  derived and/or modified sequence opt3 from hemagglutinin__InfluenzaB__AGF44887

SEQ ID NO: 148879 - RNA, 1755 nt, Artificial Sequence; identical to SEQ ID NO: 148870
  derived and/or modified sequence opt3 from hemagglutinin__InfluenzaB__AGF44888

SEQ ID NO: 148880 - RNA, 1755 nt, Artificial Sequence
  derived and/or modified sequence opt3 from hemagglutinin__InfluenzaB__AGL09834
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaggguaugauugccggcuggcacggguauacaagucauggagcucacggcguggccgucgcagccgaccucaagucuacucaggaggcuauaaauaagaucaccaaaaaccuuaauuccuuaagcgaacuggaggugaagaaccuccaacgacuuucgggugcgauggacgaacugcauaaugagauuuuggagcuagaugaaaaaguagacgaucugagagcagacacaaucucuucccagauagagcucgccguucugcuuucaaacgaagggauuaucaauagugaggaugaacaccuguuggcucucgagaggaagcugaaaaagauguuaggcccuagcgccguggacaucggaaacggcuguuucgagaccaagcacaaaugcaaucagacuugccuggaucggauugcagccgggacguuuaacgcuggagacuucucccuacccacauuugauucucucaauaucaccgccgcaagccugaacgacgauggucuugacaaucauacuauuuugcuguacuauucaaccgcggcuaguucccucgccgucacacugaugcuugcaauauucaucguguacauggucagccgugacaacgugucuuguucaauuugccuguga

SEQ ID NO: 148881 - RNA, 1755 nt, Artificial Sequence; identical to SEQ ID NO: 148870
  derived and/or modified sequence opt3 from hemagglutinin__InfluenzaB__AGL09835

SEQ ID NO: 148882 - RNA, 1755 nt, Artificial Sequence
  derived and/or modified sequence opt3 from hemagglutinin__InfluenzaB__AGL09836
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccaaaaaggcuccugggggaccauaccggcucggcaccucaggcagcugccccaacgcaacaaguaaauccggguucuuugccaccauggcuugggccguuccugaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagcccacggcguggcugucgccgcagaccucaagucuacccaggaggccauaaauaagaucacuaaaaaccuuaauuccuuaagcgaacuggaggugaagaaccuccaacgacuuucgggugcuauggacgaacugcauaaugagauuuuggagcuagaugaaaaaguagacgaucugagagcggacaccaucucuucccagauagagcucgcaguucugcuuucaaacgaagggauuaucaauagugaggaugaacaccuguuggcccucgagaggaagcugaaaaagauguuaggcccuagcgcuguggacaucggaaacggcuguuucgagacuaagcacaaaugcaaucagacgugccuggaucggauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgugacaacgugucuuguucaauuugccuguga

SEQ ID NO: 148883 - RNA, 1755 nt, Artificial Sequence; identical to SEQ ID NO: 148870
  derived and/or modified sequence opt3 from hemagglutinin__InfluenzaB__AGL09837

SEQ ID NO: 148884 - RNA, 1755 nt, Artificial Sequence; identical to SEQ ID NO: 148870
  derived and/or modified sequence opt3 from hemagglutinin__InfluenzaB__AGL09838

SEQ ID NO: 148885 - RNA, 1755 nt, Artificial Sequence; identical to SEQ ID NO: 148870
  derived and/or modified sequence opt3 from hemagglutinin__InfluenzaB__AGL09839

SEQ ID NO: 148886 - RNA, 1755 nt, Artificial Sequence; identical to SEQ ID NO: 148870
  derived and/or modified sequence opt3 from hemagglutinin__InfluenzaB__AGL09840

SEQ ID NO: 148887 - RNA, 1755 nt, Artificial Sequence; identical to SEQ ID NO: 148870
  derived and/or modified sequence opt3 from hemagglutinin__InfluenzaB__AGL09841

SEQ ID NO: 148888 - RNA, 1758 nt, Artificial Sequence
  derived and/or modified sequence opt3 from hemagglutinin__InfluenzaB__AGL09842
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgaaacgaacccacucacuauugagguccccuacaucuguacagagggugaagaucagauaaccguguggggcuuccacagugacaaugagacucagauggccaagcuguauggggauuccaagccucagaaauuuacaucuagcgcuaacggagugaccacgcacuacgucucccaaauuggcgguuucccaaaccagaccgaagacgggggacugccccagucaggccgcaucguuguggauuauaugguacagaagaguggcaaaacagggacuauuaccuaccaaagaggaauccucuuaccucagaagguguggugcgccagcgguaggucuaaagucaucaagggcucccugccacuuauuggggaggcggacuguuugcaugagaaauauggaggccugaauaagucaaagcccuacuacacaggugaacacgcaaaagccauagggaacugcccgaucugggugaagacuccucuaaaacucgcuaauggcaccaaguaucggcccccagccaaacugcuuaaggagcgcggauuuuucggcgcaauugcuggguuucuggaaggagguugggagggcaugaucgccggguggcauggauacacaagccacggcgcgcacgguguugccguggcagcugauuugaagaguacccaggaagccauaaacaaaauuacuaagaaucucaacucucuguccgaguuagaggucaaaaaucugcagcgacucagcggggcuauggacgaacuucauaacgagauccuggaauuggaugagaagguggacgaccuaagagccgauacgaucucgucucaaauugaacuggcaguacuccuguccaaugagggcaucauuaacucagaggacgaacaccuucuggccuuggagaggaaacucaagaagaugcugggaccuagugcuguugaaauaggcaauggguguuucgagacaaaacauaagugcaaccagaccugcuuagaucggaucgcggcaggaacuuuugacgccggugaguucagccugcccaccuuugauucccuaaauauuacagcugccucucucaacgacgauggccuggacaaucacaccauccuuuuguauuacagcacugcagccucaagucuggcugugacacucaugaucgccauuuucgucguguauauggucucccgugauaacgugagcuguucuauaugccuguga

SEQ ID NO: 148889 - RNA, 1755 nt, Artificial Sequence; identical to SEQ ID NO: 148870
  derived and/or modified sequence opt3 from hemagglutinin__InfluenzaB__AGL09843

SEQ ID NO: 148890 - RNA, 1755 nt, Artificial Sequence
  derived and/or modified sequence opt3 from hemagglutinin__InfluenzaB__AGL09844
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagaaagaggauggugggcucccacagagcggacgcaucguuguggacuacaugaugcaaaagcccggcaaaacgggcaccauaguauaucagagagggguguuacugccucagaaggucuggugcgcuucuggaagguccaaagugauuaaggguucacuuccauugaucggcgaagccgauugucugcaugagaaauacgggggacuaaacaagagcaagcccuacuauacaggcgaacacgcaaaagcuauugguaauugcccgaucuggguuaagacuccucucaaacuggccaacgggaccaaguaccggcccccagcgaaacuucugaaggagcgcggcuuuuucggagccaucgcaggcuuuuuggaagggggaugggaagguaugauugcuggcuggcacggguauacaagucauggagcccacggcguggcugucgccgcagaccucaagucuacucaggaggccauaaauaaaaucaccaagaacuuaaauucccugagcgaacuggaggugaaaaaccuccaacgacuuucgggugcuauggacgaacugcauaaugagauuuuggagcuagaugaaaagguagacgaucugagagcggacacaaucucuucccagauagagcucgcaguucugcuuucaaacgaagggauuaucaauagugaggaugaacaccuguuggcccucgagaggaaacugaagaagauguuaggcccuagcgcuguggacaucggaaacggcuguuucgagaccaaacacaagugcaaucagacuugccuggaucggauugccgcagggacguuuaacgccggagaguucucccuacccacauuugacucucucaauaucaccgcugccagccugaacgaugacggucuugauaaucauacuauuuugcuguacuauucaaccgcagcgaguucccucgcugucacacugaugcuugccauauucaucguguacauggucagccgugacaacgugucuuguucaauuugccuguga

SEQ ID NO: 148891 - RNA, 1755 nt, Artificial Sequence; identical to SEQ ID NO: 148870
  derived and/or modified sequence opt3 from hemagglutinin__InfluenzaB__AGL09845

SEQ ID NO: 148892 - RNA, 1755 nt, Artificial Sequence; identical to SEQ ID NO: 148870
  derived and/or modified sequence opt3 from hemagglutinin__InfluenzaB__AGL09846

SEQ ID NO: 148893 - RNA, 1755 nt, Artificial Sequence
  derived and/or modified sequence opt3 from hemagglutinin__InfluenzaB__AGL09847
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccauuugggguuuccauucugacaauaaaacacagaugaagaaccuguacggcgauagcaauccccaaaaguuuaccuccucagcuaacggggugacuacacacuaugugagucagaucggaggcuucccugaccagaccgaggauggugggcucccacagagcggacgcauagucguugacuacaugaugcaaaaacccggcaagacgggcaccauuguguaucagagagggguauuacugccucagaaaguguggugcgccucuggaagguccaaggucaucaaagguucacuuccauugauuggcgaagcagauugucugcaugagaaguacgggggacuaaacaaaagcaagcccuacuauacaggcgaacacgcuaaggccaucgguaauugcccgaucugggugaaaacuccucucaagcuggcgaacgggaccaaauaccggcccccagccaagcugcugaaagagcgcggcuuuuucggagcaauugcuggcuuuuuggaagggggaugggaagguaugauagccggcuggcacggguauacaagucauggagcucacggcguugccguggcagccgaccucaagucuacucaggaggcuaucaauaagauuaccaaaaaccuuaauuccuuaagcgaacuggaggucaagaaccuccaacgacuuucgggugcgauggacgaacugcauaaugagaucuuggagcuagaugaaaaaguggacgaucugagagcagacacaauaucuucccagauugagcucgccguacugcuuucaaacgaagggaucaucaauagugaggaugaacaccuguuggcucucgagaggaagcugaaaaagauguuaggcccuagcgccguugacauuggaaacggcuguuucgagaccaagcacaaaugcaaucagacuugccuggaucggaucgcagccgggacguuuaacgcuggagaguucucccuacccacauuugacucucucaauauuaccgccgcaagccugaacgaugacggucuugauaaucauacuauauugcuguacuauucaaccgcggcuaguucccucgccgugacacugaugcuugcaaucuucauugucuacauggugagccgugacaacgucucuuguucaaucugccuguga

SEQ ID NO: 148894 - RNA, 1755 nt, Artificial Sequence
  derived and/or modified sequence opt3 from hemagglutinin__InfluenzaB__AGL09849
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucaacgccgaaaaagcuccugggggaccauaccggcucggcaccucaggcagcugccccaaugcaacaaguaaguccggguucuuugccaccauggcuugggccguuccuaaagauaacaauaagaacgcgacgaauccacugacuguggaggucccguauauuugugcagaaggagaggaccagaucacagugugggguuuccauucugauaacaaaacccagaugaagaaucuguacggcgacagcaacccccaaaaguuuacuuccucagccaacggggugacaacccacuaugucagucagauuggaggcuucccugaucagacggaggacggugggcucccacagagcggacgcaucguuguggauuacaugaugcaaaaacccggcaagaccggcacaauaguauaucagagagggguguuacugccucagaaagucuggugcgcuucuggaagguccaaggugauuaaagguucacuuccauugaucggcgaagccgacugucugcaugagaaguacgggggacuaaauaaaagcaagcccuacuauacuggcgaacacgcaaaggcuauugguaacugcccgaucuggguuaaaaccccucucaagcuggccaaugggacaaaauaccggcccccagcgaaacuucugaaggagcgcggcuuuuucggagccaucgcaggcuuuuuggaagggggaugggaagguaugauugcuggcuggcacggguauacaagucauggagcccacggcguggcugucgccgcagaucucaagucuacccaggaggccauaaacaagaucacuaaaaaucugaacuccuuaagcgaacuggaggugaagaaucuccaacgacuuucgggugcuauggacgaacugcauaacgagauuuuggagcuagacgaaaaaguagaugaccugagagcggauaccaucucuucccagauagagcucgcaguucugcuuucaaaugaagggauuaucaacagugaggacgaacaccuguuggcccucgagaggaagcugaaaaagauguuaggcccuagcgcuguggauaucggaaauggcuguuucgagacuaagcacaaaugcaaccagacgugccuggaccggauugccgcagggacauuuaaugccggagaguucucccuacccaccuuugauucucucaacaucacugcugccagccugaaugacgauggucuugacaaccauaccauuuugcuguacuauucaacagcagcgaguucccucgcugucacccugaugcuugccauauucaucguguacauggucagccgugauaacgugucuuguucaauuugccuguga

SEQ ID NO: 148895 - RNA, 1755 nt, Artificial Sequence; identical to SEQ ID NO: 148870
  derived and/or modified sequence opt3 from hemagglutinin__InfluenzaB__AGL09850

SEQ ID NO: 148896 - RNA, 1755 nt, Artificial Sequence; identical to SEQ ID NO: 148870
  derived and/or modified sequence opt3 from hemagglutinin__InfluenzaB__AGL09851

SEQ ID NO: 148897 - RNA, 1758 nt, Artificial Sequence; identical to SEQ ID NO: 148661
  derived and/or modified sequence opt3 from hemagglutinin__InfluenzaB__AGL09852

SEQ ID NO: 148898 - RNA, 1755 nt, Artificial Sequence; identical to SEQ ID NO: 148870
  derived and/or modified sequence opt3 from hemagglutinin__InfluenzaB__AGL09853

SEQ ID NO: 148899 - RNA, 1755 nt, Artificial Sequence; identical to SEQ ID NO: 148870
  derived and/or modified sequence opt3 from hemagglutinin__InfluenzaB__AGL09854

SEQ ID NO: 148900 - RNA, 1758 nt, Artificial Sequence
  derived and/or modified sequence opt3 from hemagglutinin__InfluenzaB__AGL09855
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgaaacgaacccacucacuauugagguccccuacaucuguacagaggaagaggaucagauaaccgugugggguuuccacagugacaaugaaacucagauggccaagcuguauggcgauuccaagccucagaaauuuacaucuagcgcuaacggggugaccacgcacuacgucucccaaauuggagacuucccaaaccagaccgaggauggcggucugccccagucagggcgcaucguuguggacuauaugguacagaagaguggaaaaacaggcacuauuaccuaccaaagaggcauccucuuaccucagaagguguggugcgccagcgggaggucuaaagucaucaagggaucccugccacuuauuggugaggcggauuguuugcaugaaaaauauggcgggcugaauaagucaaagcccuacuacacaggagagcacgcaaaagccauaggcaacugcccgaucugggugaagacuccucuaaaacucgcuaaugguaccaaguaucggcccccagccaaacugcuuaaggaacgcggguuuuucggcgcaauugcuggauuucuggagggcgggugggaaggaaugaucgccgguuggcauggcuacacaagccacggggcgcacggaguugccguggcagcugacuugaagaguacccaggaggccauaaacaaaauuacuaagaaucucaacucucuguccgaguuagaagucaaaaaucugcagcgacucagcggcgcuauggaugagcuucauaacgaaauccuggaguuggacgaaaagguggacgaucuaagagccgacacgaucucgucucaaauugagcuggcaguacuccuguccaaugaggguaucauuaacucagaagaugagcaccuucuggccuuggaaaggaaacucaagaagaugcuggggccuagugcuguugagauaggcaauggauguuucgaaacaaaacauaagugcaaccagaccugcuuagaccggaucgcggcaggcacuuuugaugccggggaguucagccugcccaccuuugacucccuaaauauuacagcugccucucucaacgaugacggacuggauaaucacaccauccuuuuguauuacagcacugcagccucaagucuggcugugacacucaugaucgccauuuucgucguguauauggucucccgugacaacgugagcuguucuauaugccuguga

SEQ ID NO: 148901 - RNA, 1755 nt, Artificial Sequence; identical to SEQ ID NO: 148870
  derived and/or modified sequence opt3 from hemagglutinin__InfluenzaB__AGL09856

SEQ ID NO: 148902 - RNA, 1755 nt, Artificial Sequence
  derived and/or modified sequence opt3 from hemagglutinin__InfluenzaB__AGL09857
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaaaguaaucgaugccgaaaaggcuccugggggaccauaccggcucggcaccucaggcagcugccccaaugcaacaaguaaauccggguucuuugccaccauggcuugggccguuccuaaggacaacaauaaaaacgcgacgaauccacugacuguggaggucccguauauuugugcagaaggagaggaucagaucacagugugggguuuccauucugacaacaagacccagaugaagaaucuguacggcgauagcaacccccaaaaauuuacuuccucagccaauggggugacaacccacuaugucagucagauuggaggcuucccugaccagacggaggauggugggcucccacagagcggacgcaucguuguggacuacaugauacaaaagcccggcaaaaccggcacaauuguauaucagagagggguguuacugccucagaaggucuggugcgcuucuggaagguccaaagugaucaaggguucacuuccauugauuggcgaagccgauugucugcaugagaaauacgggggacuaaacaagagcaagcccuacuauacuggcgaacacgcaaaagcuaucgguaacugcccgaucuggguuaagaccccucucaaacuggccaaugggacaaaguaccggcccccagcgaaacuucugaaggagcgcggcuuuuucggagccauugcaggcuuuuuggaagggggaugggaagguaugauagcuggcuggcacggguauaccagucauggagcccacggcguggcugucgccgcagaccucaagucuacucaggaggccaucaacaaaauuacaaagaaucugaacuccuuaagcgaacuggaggugaaaaaucuccaacgacuuucgggugcuauggacgaacugcauaacgagaucuuggagcuagaugaaaagguagacgaucugagagcggacaccauaucuucccagauugagcucgcaguucugcuuucaaaugaagggaucaucaacagugaggaugaacaccuguuggcccucgagaggaaacugaagaagauguuaggcccuagcgcuguggacauuggaaauggcuguuucgagacuaaacacaagugcaaccagacgugccuggaucggaucgccgcagggacauuuaaugccggagaguucucccuacccaccuuugacucucucaacauuacugcugccagccugaaugaugacggucuugauaaccauaccauauugcuguacuauucaacagcagcgaguucccucgcugucacccugaugcuugccaucuucauuguguacauggucagccgugacaaugugucuuguucaaucugccuguga

SEQ ID NO: 148903 - RNA, 1758 nt, Artificial Sequence
  derived and/or modified sequence opt3 from hemagglutinin__InfluenzaB__AGL09859
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaauaaaauuacuaagaaccucaauucucuguccgaauuagaggucaaaaaccugcagcgacucagcggggccauggaugagcuucauaaugaaauccuggaguuggacgaaaagguggacgaucuaagagcagacacgaucucgucucaaauugagcuggccguacuccuguccaacgaaggcaucauuaauucagaggaugagcaccuucuggcuuuggaaaggaaacucaagaagaugcugggaccuagugcgguugagauaggcaacggguguuucgaaacaaaacauaagugcaaucagaccugcuuagaccggaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 148904 - RNA, 1758 nt, Artificial Sequence; identical to SEQ ID NO: 148903
  derived and/or modified sequence opt3 from hemagglutinin__InfluenzaB__AGL09860

SEQ ID NO: 148905 - RNA, 1758 nt, Artificial Sequence; identical to SEQ ID NO: 148903
  derived and/or modified sequence opt3 from hemagglutinin__InfluenzaB__AGL09861

SEQ ID NO: 148906 - RNA, 1758 nt, Artificial Sequence; identical to SEQ ID NO: 148903
  derived and/or modified sequence opt3 from hemagglutinin__InfluenzaB__AGL09862

SEQ ID NO: 148907 - RNA, 1758 nt, Artificial Sequence; identical to SEQ ID NO: 148903
  derived and/or modified sequence opt3 from hemagglutinin__InfluenzaB__AGL09863

SEQ ID NO: 148908 - RNA, 1755 nt, Artificial Sequence; identical to SEQ ID NO: 148870
  derived and/or modified sequence opt3 from hemagglutinin__InfluenzaB__AGL09864

SEQ ID NO: 148909 - RNA, 1755 nt, Artificial Sequence; identical to SEQ ID NO: 148870
  derived and/or modified sequence opt3 from hemagglutinin__InfluenzaB__AGL09866

SEQ ID NO: 148910 - RNA, 1755 nt, Artificial Sequence; identical to SEQ ID NO: 148870
  derived and/or modified sequence opt3 from hemagglutinin__InfluenzaB__AGL09867

SEQ ID NO: 148911 - RNA, 1755 nt, Artificial Sequence; identical to SEQ ID NO: 148870
  derived and/or modified sequence opt3 from hemagglutinin__InfluenzaB__AGL09868

SEQ ID NO: 148912 - RNA, 1755 nt, Artificial Sequence
  derived and/or modified sequence opt3 from hemagglutinin__InfluenzaB__AGL09869
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacacaaccaguaaguccggguucuuugcaacgauggccugggcuguuccuaaagacaauaacaagaaugccacuaacccacugacaguggaggucccguauauuugugcggaaggagaggaucagaucaccgugugggguuuccauucugacaauaaaacucagaugaagaaccuguacggcgauagcaauccccaaaaguuuacauccucagcaaacggggugaccacgcacuaugucagucagauuggaggcuucccugaccagaccgaggauggugggcucccacagagcggacgcaucguuguggacuacaugaugcaaaaacccggcaagacaggcacuauaguauaucagagagggguguuacugccucagaaagucuggugcgccucuggaagguccaaggugauuaaagguucacuuccauugaucggcgaagcugauugucugcaugagaaguacgggggacuaaacaaaagcaagcccuacuauaccggcgaacacgccaaggcaauugguaauugcccgaucuggguuaaaacaccucucaagcuggcuaacgggacuaaauaccggcccccagccaagcugcugaaagagcgcggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaagaucaccaaaaaccuuaauuccuuaagcgaacuggaggugaagaaccuccaacgacuuucgggugccauggacgaacugcauaaugagauuuuggagcuagaugaaaaaguagacgaucugagagcugacacuaucucuucccagauagagcucgcgguucugcuuucaaacgaagggauuaucaauagugaggaugaacaccuguuggcacucgagaggaagcugaaaaagauguuaggcccuagcgccguggacaucggaaacggcuguuucgagacgaagcacaaaugcaaucagacaugccuggaucggauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagccgugacaacgugucuuguucaauuugccuguga

SEQ ID NO: 148913 - RNA, 1755 nt, Artificial Sequence
  derived and/or modified sequence opt3 from hemagglutinin__InfluenzaB__AGL09870
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaacgcuuuacuuccucagccaacggggugacaacccacuaugucagucagauuggaggcuucccugaccagacggaggauggugggcucccacagagcggaagaaucguuguggacuacaugaugcaaaagcccggcaaaaccggcacaauaguauaucagcgcgggguguuacugccucagaaggucuggugcgcuucuggacgguccaaagugauuaaggguucacuuccauugaucggcgaagccgauugucugcaugagaaauacgggggacuaaacaagagcaaacccuacuauacuggcgaacacgcaaaggcuauugguaauugcccgaucuggguuaagaccccucucaaacuggccaacgggacaaaguacaggcccccagcgaaacuucugaaggagcgaggcuuuuucggagccaucgcaggcuuuuuggaagggggaugggaagguaugauugcuggcuggcacggguauacuucccauggagcccacggcguggcugucgccgcagaccucaaaucuacccaggaggccauaaauaagaucacaaagaaccugaauaguuuaagcgaacuggaggugaaaaaccuccaaagacuuucgggugcuauggacgaacugcauaaugagauuuuggagcuagaugaaaagguagacgaucugagggcggacaccaucucuucccagauagagcucgcaguucugcuuucaaacgaagggauuaucaauagugaggaugaacaccuguuggcccucgagcggaaacugaagaaaauguuaggcccuagcgcuguggacaucggaaacggcuguuucgagacuaagcacaagugcaaucagacgugccuggaucguauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgcgacaacgugucuuguucaauuugccuguga

SEQ ID NO: 148914 - RNA, 1755 nt, Artificial Sequence; identical to SEQ ID NO: 148870
  derived and/or modified sequence opt3 from hemagglutinin__InfluenzaB__AGL09871

SEQ ID NO: 148915 - RNA, 1755 nt, Artificial Sequence
  derived and/or modified sequence opt3 from hemagglutinin__InfluenzaB__AGL09872
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaagguaugauugccggcuggcacggguauacaagucauggagcucacggcguggccgucgcagccgaccucaagucuacucaggaggcuauaaauaagaucaccaaaaaccuuaauuccuuaagcgaacuggaggugaagaaccuccaacgacuuucgggugcgauggacgaacugcauaaugagauuuuggagcuagaugaaaaaguagacgaucugagagcagacacaaucucuucccagauagagcucgccguucugcuuucaaacgaagggauuaucaauagugaggaugaacaccuguuggcucucgagaggaagcugaaaaagauguuaggcccuagcgccguggacaucggaaacggcuguuucgagaccaagcacaaaugcaaucagacuugccuggaucggauugcagccgggacguuuaacgcuggagaguucucccuacccacauuugacucucucaauaucaccgccgcaagccugaacgaugacggucuugauaaucauacuauuuugcuguacuauucaaccgcggcuaguucccucgccgucacacugaugcuugcaauauucaucguguacauggucagccgugacaacgugucuuguucaauuugccuguga

SEQ ID NO: 148916 - RNA, 1755 nt, Artificial Sequence; identical to SEQ ID NO: 148870
  derived and/or modified sequence opt3 from hemagglutinin__InfluenzaB__AGL09873

SEQ ID NO: 148917 - RNA, 1758 nt, Artificial Sequence; identical to SEQ ID NO: 148903
  derived and/or modified sequence opt3 from hemagglutinin__InfluenzaB__AGL09874

SEQ ID NO: 148918 - RNA, 1758 nt, Artificial Sequence; identical to SEQ ID NO: 148888
  derived and/or modified sequence opt3 from hemagglutinin__InfluenzaB__AGO02695

SEQ ID NO: 148919 - RNA, 1755 nt, Artificial Sequence; identical to SEQ ID NO: 148870
  derived and/or modified sequence opt3 from hemagglutinin__InfluenzaB__AGQ16249

SEQ ID NO: 148920 - RNA, 1758 nt, Artificial Sequence; identical to SEQ ID NO: 148903
  derived and/or modified sequence opt3 from hemagglutinin__InfluenzaB__AGQ16250

SEQ ID NO: 148921 - RNA, 1758 nt, Artificial Sequence; identical to SEQ ID NO: 148903
  derived and/or modified sequence opt3 from hemagglutinin__InfluenzaB__AGQ16251

SEQ ID NO: 148922 - RNA, 1755 nt, Artificial Sequence
  derived and/or modified sequence opt3 from hemagglutinin__InfluenzaB__AGQ16252
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccagccaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacugccuaaucuucugagggguuaugagaacauacgguugucgacacagaauguaaucgaugccgaaaaggcuccagggggacccuaccgccucggcacuucaggcagcugcccuaacgcaaccaguaaaauuggguucuuugccacaauggcuugggccguuccaaaggacaauuauaaaaacgcgaccaauccgcugacgguggagguccccuacaucuguaaggaaggagaggaucagauuacugugugggguuuccauuccgacaacaaaacacagaugaagaaucuguauggcgauucuaacccucaaaaguuuaccagcuccgcaaauggggugacuacacacuacgucucacagaucggagacuucccagaucagaccgaggacggcggucucccccagagugggagaauaguuguggauuauaugaugcaaaaaccuggaaagacgggcaccauuguauaccagaggggcguguuacugccacagaaagucuggugcgccagcgggcggucuaaggugaucaaaggaucccuucccuugauuggugaagcugacugucugcaugaggaauacggcgggcuaaacaagucaaaaccguauuacacaggaaagcacgccaaggcaaucggcaacugcccuaucuggguuaaaacuccccucaagcuggcuaaugguaccaaauaucgcccuccagccaaacuucugaaggagcgaggguuuuucggcgcgauugccggauuuuuggagggcgggugggaaggaaugauagcagguuggcacggcuacacaagccauggggcucacggaguggccgucgcugccgaccucaagaguacucaggaggcaaucaacaagauuaccaaaaaucugaacucuuuauccgaacuggaggugaagaaucuccaaagacuuagcggcgccauggaugaacugcauaacgagaucuuggagcuagacgaaaaaguagaugaccugagggcugauacaauaucgucucagauugagcucgcgguucugcuuuccaaugaagguaucaucaacucagaggacgaacaccuguuggcacucgagcggaagcugaaaaagauguuagggcccagugccguggauauuggcaauggauguuucgagaccaagcacaaaugcaaccagacuugccuggaccguaucgcugccggcacguuuaaugcaggggaguucagccuaccaacauuugauucccucaacauuaccgccgcuucucugaaugacgauggacuugacaaccauacuauauugcuguauuacagcaccgccgcaucaagucucgcggucacacugaugcuugcuaucuucauuguguauauggucucccgcgacaaugugagcuguucuaucugccuguga

SEQ ID NO: 148923 - RNA, 1755 nt, Artificial Sequence; identical to SEQ ID NO: 148870
  derived and/or modified sequence opt3 from hemagglutinin__InfluenzaB__AGQ16253

SEQ ID NO: 148924 - RNA, 1755 nt, Artificial Sequence
  derived and/or modified sequence opt3 from hemagglutinin__InfluenzaB__AGQ16255
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacgggauuacaacccacuaugugagucagaucggaggcuucccugaccagacggaggauggugggcucccacagagcggacgcauagucguugacuacaugaugcaaaaacccggcaagaccggcacaauuguguaucagagagggguauuacugccucagaaaguguggugcgcuucuggaagguccaaggucaucaaagguucacuuccauugauuggcgaagccgauugucugcaugagaaguacgggggacuaaacaaaagcaagcccuacuauacuggcgaacacgcaaaggcuaucgguaauugcccgaucugggugaaaaccccucucaagcuggccaacgggacaaaauaccggcccccagcgaagcugcugaaagagcgcggcuuuuucggagccauugcaggcuuuuuggaagggggaugggaagguaugauagcuggcuggcacggguauacaagucauggagcccacggcguugcuguggccgcagaccucaagucuacccaggaggccaucaauaagauuacuaaaaaccuuaauuccuuaagcgaacuggaggucaagaaccuccaacgacuuucgggugcuauggacgaacugcauaaugagaucuuggagcuagaugaaaaaguggacgaucugagagcggacaccauaucuucccagauugagcucgcaguacugcuuucaaacgaagggaucaucaauagugaggaugaacaccuguuggcccucgagaggaagcugaaaaagauguuaggcccuagcgcuguugacauuggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauauaaucuugcuguacuauucaaccgcagcgaguucccucgcugugacacugaugcuugccauuuucaucgucuacauggugagccgugacaacgucucuuguucaaucugccuguga

SEQ ID NO: 148925 - RNA, 1755 nt, Artificial Sequence
  derived and/or modified sequence opt3 from hemagglutinin__InfluenzaB__AGQ16256
augaaggccaucauugugcugcucauggucguuaccagcaacgcugacagaauaugcacaggcaucacuuccucuaauucaccccacgugguaaaaacggugacccagggggaggucaacgugacaggaguuauuccucuuacuaccacaccaaccaagaguuacuucgcaaaucugaaagguacuaagacaaggggcaaauuguguccggauugcuuaaacuguaccgaccuggauguggcccuagggcggcccaugugcgucggaacgacuccuagcgcgaaggcuuccauccuccaugaagugcgcccaguaaccucuggcuguuuucccauuaugcacgaccgaacaaagauccgucaacuggccaaucuucugagagguuaugagaacauaagguugucgacucagaauguuaucgaugcagaaaaagccccugggggaccauaccggcucggcaccucaggcagcugccccaacgcuacaaguaaguccggguucuuugcaaccauggccugggcugugccuaaagacucuaauaagaacgccacgaauccacugacugucgaggugccguauauuugugcggaaggagaggaucagaucacagugugggguuuccauagcgacaacaaaacccagaugaagaaucuguacggcgauuccaacccccaaaaguuuacuucaagugcaaauggggucacaacccacuauguuagccagauuggaggcuucccugaccagacggaggauggugggcucccacagucuggacgcaucgugguagacuacaugaugcaaaaacccggcaagaccggcacaauaguguaucagagaggggucuuacugccucagaaaguguggugcgccuccggaaggucaaagguuauuaaagguagccuuccauugaucggcgaagcugauugucugcaugagaaguacgggggacuaaacaaaaguaagcccuacuauacuggcgaacacgccaaggcaauugguaacugcccgaucugggugaaaaccccucucaagcuggcuaaugggacaaaauaccggcccccagccaaacuucugaaagagcgcggcuuuuucggagcgaucgccggcuuuuuggaagggggaugggaagguaugauugcaggcuggcacggguauacuucucauggagcucacggcgucgccguggcugccgaccucaaguccacccaggaggcaauaaacaagaucacaaagaaucugaacagcuuaucggaacuggagguaaagaaucuccaacgacuuucuggugccauggacgaacugcauaacgagauuuuggagcuagaugaaaaaguugacgaucugagagcugacaccaucuccucacagauagagcucgcggugcugcuuaguaaugaagggauuaucaacagcgaggaugaacaccuguuggcacucgagaggaagcugaaaaagauguuaggcccuuccgccgucgacaucggaaauggcuguuucgagacuaagcacaaaugcaaccagacgugccuggaucggauugcugccgggacauuuaaugcaggagaguucucucuacccaccuuugacagccucaacaucacugccgcuucacugaaugaugacggucuugauaaccauaccauuuugcuguacuauaguacagccgcauccagccucgcggugacccugaugcuugcuauauucaucgucuacauggugucucgugacaauguuucauguaguauuugccuguga

SEQ ID NO: 148926 - RNA, 1755 nt, Artificial Sequence; identical to SEQ ID NO: 148870
  derived and/or modified sequence opt3 from hemagglutinin__InfluenzaB__AGQ16257

SEQ ID NO: 148927 - RNA, 1755 nt, Artificial Sequence; identical to SEQ ID NO: 148870
  derived and/or modified sequence opt3 from hemagglutinin__InfluenzaB__AGQ16258

SEQ ID NO: 148928 - RNA, 1755 nt, Artificial Sequence; identical to SEQ ID NO: 148870
  derived and/or modified sequence opt3 from hemagglutinin__InfluenzaB__AGQ16259

SEQ ID NO: 148929 - RNA, 1755 nt, Artificial Sequence
  derived and/or modified sequence opt3 from hemagglutinin__InfluenzaB__AGQ16260
augaagaccaucauugugcugcucauggucguuacaagcaacgccgacagaauaugcacuggcaucacguccucuaauucaccccacgugguaaaaaccgcuacacagggggaggugaacgucacuggagugauuccucuuaccacaaccccaacuaagaguuacuucgcaaaucugaaagguacaaagaccaggggcaaauuguguccggauugcuuaaacuguacggaccuggauguugcccuagggcggcccaugugcgugggaacuaccccuagcgcgaaggcuuccauccuccaugaaguccgcccagugacaucuggcuguuuucccauuaugcacgaccgaacuaagauccgucaacuggccaaucuucugagagguuaugagaacauaagguugucgucacagaauguaaucgaugcagaaaaagccccugggggaccauaccggcucggcaccagcggcaguugccccaacgcuacauccaagucuggguucuuugcaaccauggccugggcuguuccuaaagacaauaacaagaaugccacgaacccacugacuguggaggucccguauauuugugcggaaggagaggaucagaucacagugugggguuuccauagcgacaauaaaacccagaugaagaaccuguacggcgauuccaauccccaaaaguuuacuucaagugcaaacggggugacaacccacuaugucagccagauuggaggcuucccugaccagacggaggauggugggcucccacagucuggacgcaucguuguggacuacaugaugcaaaaacccggcaagaccggcacaauaguauaucagagagggguguuacugccucagaaagucuggugcgccuccggaaggucaaaggugauuaaagguagccuuccauugaucggcgaagcugauugucugcaugagaaguacgggggacuaaacaaaaguaagcccuacuauacuggcgaacacgccaaggcaauugguaauugcccgaucuggguuaaaaccccucucaagcuggcuaacgggacaaaauaccggcccccagccaaacuucugaaagagcgcggcuuuuucggagcgaucgccggcuuuuuggaagggggaugggaagguaugauugcaggcuggcacggguauacuucucauggagcucacggcguggccgucgcugccgaccucaaguccacccaggaggcaauaaauaagaucacaaagaaccugaauagcuuaucggaacuggaggugaagaaccuccaacgacuuucuggugccauggacgaacugcauaaugagauuuuggagcuagaugaaaaaguagacgaucugagagcugacaccaucuccucacagauagagcucgcgguucugcuuaguaacgaagggauuaucaauagcgaggaugaacaccuguuggcacucgagaggaagcugaaaaagauguuaggcccuuccgccguggacaucggaaacggcuguuucgagacuaagcacaaaugcaaucagacgugccuggaucggauugcugccgggacauuuaacgcaggagaguucucucuacccaccuuugacagccucaauaucacugccgcuucacugaacgaugacggucuugauaaucauaccauuuugcuguacuauaguacagccgcauccagccucgcggucacccugaugcuugcuauauucaucguguacauggucucucgugacaacgugucauguaguauuugccuguga

SEQ ID NO: 148930 - RNA, 1755 nt, Artificial Sequence; identical to SEQ ID NO: 148870
  derived and/or modified sequence opt3 from hemagglutinin__InfluenzaB__AGQ16261

SEQ ID NO: 148931 - RNA, 1755 nt, Artificial Sequence; identical to SEQ ID NO: 148870
  derived and/or modified sequence opt3 from hemagglutinin__InfluenzaB__AGQ16262

SEQ ID NO: 148932 - RNA, 1758 nt, Artificial Sequence; identical to SEQ ID NO: 148903
  derived and/or modified sequence opt3 from hemagglutinin__InfluenzaB__AGQ16263

SEQ ID NO: 148933 - RNA, 1758 nt, Artificial Sequence; identical to SEQ ID NO: 148903
  derived and/or modified sequence opt3 from hemagglutinin__InfluenzaB__AGQ16264

SEQ ID NO: 148934 - RNA, 1755 nt, Artificial Sequence; identical to SEQ ID NO: 148915
  derived and/or modified sequence opt3 from hemagglutinin__InfluenzaB__AGQ16265

SEQ ID NO: 148935 - RNA, 1755 nt, Artificial Sequence
  derived and/or modified sequence opt3 from hemagglutinin__InfluenzaB__AGQ16266
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagguuggaggcuucccugaccagacggaggauggugggcucccacagagcggacgcauugugguagacuacaugaugcaaaaacccggcaagaccggcacaaucguguaucagagaggggucuuacugccucagaaaguguggugcgcuucuggaagguccaagguuauaaaagguucacuuccauugauuggcgaagccgauugucugcaugagaaguacgggggacuaaacaaaagcaagcccuacuauacuggcgaacacgcaaaggcuaucgguaauugcccgauuugggugaaaaccccucucaagcuggccaacgggacaaaauaccggcccccagcgaagcugcugaaagagcgcggcuuuuucggagccaucgcaggcuuuuuggaagggggaugggaagguaugaucgcuggcuggcacggguauacaagucauggagcccacggcgucgcuguggccgcagaccucaagucuacccaggaggccauuaauaagauaacuaaaaaccuuaauuccuuaagcgaacuggagguaaagaaccuccaacgacuuucgggugcuauggacgaacugcauaaugagaucuuggagcuagaugaaaaaguugacgaucugagagcggacaccauuucuucccagaucgagcucgcagugcugcuuucaaacgaagggauaauuaauagugaggaugaacaccuguuggcccucgagaggaagcugaaaaagauguuaggcccuagcgcugucgacaucggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccaucuugcuguacuauucaacagcagcgaguucccucgcugugacccugaugcuugccauuuucauagucuacauggugagccgugacaacguuucuuguucaaucugccuguga

SEQ ID NO: 148936 - RNA, 1755 nt, Artificial Sequence; identical to SEQ ID NO: 148915
  derived and/or modified sequence opt3 from hemagglutinin__InfluenzaB__AGQ16267

SEQ ID NO: 148937 - RNA, 1755 nt, Artificial Sequence; identical to SEQ ID NO: 148915
  derived and/or modified sequence opt3 from hemagglutinin__InfluenzaB__AGQ16268

SEQ ID NO: 148938 - RNA, 1758 nt, Artificial Sequence; identical to SEQ ID NO: 148888
  derived and/or modified sequence opt3 from hemagglutinin__InfluenzaB__AGQ16269

SEQ ID NO: 148939 - RNA, 1755 nt, Artificial Sequence; identical to SEQ ID NO: 148915
  derived and/or modified sequence opt3 from hemagglutinin__InfluenzaB__AGQ16270

SEQ ID NO: 148940 - RNA, 1755 nt, Artificial Sequence
  derived and/or modified sequence opt3 from hemagglutinin__InfluenzaB__AGQ16272
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccucgcgacaauaacaaaaaugcgacgaacccacugacuguggaggucccguauauuugugaagagggagaggaucagaucacagugugggguuuccauucugacaauaagacccagaugaaaaaccuguacggcgauagcaauccccaaaaguuuacuuccucagcaaacggggugacaacccacuaugucagucagauuggaggcuucccugaccagacggaagauggugggcucccacagagcggaagaaucguuguggacuacaugaugcaaaagcccggcaaaaccggcacaauaguauaucagcgcgggguguuacugccucagaaggucuggugcgccucuggacgguccaaagugauuaaggguucacuuccauugaucggcgaggcugauugucugcaugaaaaauacgggggacuaaacaagagcaaacccuacuauacuggcgagcacgccaaggcaauugguaauugcccgaucuggguuaagaccccucucaaacuggcuaacgggacaaaguacaggcccccagccaaacuucugaaggagcgaggcuuuuucggagcgaucgccggcuuuuuggaagggggaugggaggguaugauugcaggcuggcacggguauacuucccauggagcucacggcguggccgucgcugccgaccucaaaucuacccaggaagcaauaaauaagaucacaaagaaccugaauaguuuaagcgagcuggaagugaaaaaccuccaaagacuuucgggugccauggacgagcugcauaaugagauuuuggaacuagaugagaagguagacgaucugagggcugacaccaucucuucccagauagaacucgcgguucugcuuucaaacgaggggauuaucaauagugaagaugagcaccuguuggcacucgagcggaaacugaagaaaauguuaggcccuagcgccguggacaucggaaacggcuguuucgaaacuaagcacaagugcaaucagacgugccuggaucguauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgcgacaacgugucuuguucaauuugccuguga

SEQ ID NO: 148941 - RNA, 1755 nt, Artificial Sequence; identical to SEQ ID NO: 148870
  derived and/or modified sequence opt3 from hemagglutinin__InfluenzaB__AGQ16273

SEQ ID NO: 148942 - RNA, 1755 nt, Artificial Sequence; identical to SEQ ID NO: 148870
  derived and/or modified sequence opt3 from hemagglutinin__InfluenzaB__AGQ16274

SEQ ID NO: 148943 - RNA, 1755 nt, Artificial Sequence; identical to SEQ ID NO: 148870
  derived and/or modified sequence opt3 from hemagglutinin__InfluenzaB__AGQ16275

SEQ ID NO: 148944 - RNA, 1755 nt, Artificial Sequence; identical to SEQ ID NO: 148870
  derived and/or modified sequence opt3 from hemagglutinin__InfluenzaB__AGQ16276

SEQ ID NO: 148945 - RNA, 1755 nt, Artificial Sequence; identical to SEQ ID NO: 148915
  derived and/or modified sequence opt3 from hemagglutinin__InfluenzaB__AGQ16277

SEQ ID NO: 148946 - RNA, 1755 nt, Artificial Sequence; identical to SEQ ID NO: 148915
  derived and/or modified sequence opt3 from hemagglutinin__InfluenzaB__AGQ16278

SEQ ID NO: 148947 - RNA, 1755 nt, Artificial Sequence; identical to SEQ ID NO: 148915
  derived and/or modified sequence opt3 from hemagglutinin__InfluenzaB__AGQ16279

SEQ ID NO: 148948 - RNA, 1755 nt, Artificial Sequence; identical to SEQ ID NO: 148915
  derived and/or modified sequence opt3 from hemagglutinin__InfluenzaB__AGQ16280

SEQ ID NO: 148949 - RNA, 1755 nt, Artificial Sequence
  derived and/or modified sequence opt3 from hemagglutinin__InfluenzaB__AGQ16281
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggcagcuucccugaccagacggaggauggaggucucccacagucugggcgcaucguuguggacuacaugaugcaaaaacccggaaagaccggcacaauaguauaucagagaggcguguuacugccucagaaagucuggugcgcuuccgggaggucaaaggugauuaaaggaagccuuccauugaucggugaagccgauugucugcaugagaaguacggcgggcuaaacaaaaguaagcccuacuauacuggagaacacgcaaaggcuauuggcaauugcccgaucuggguuaaaaccccucucaagcuggccaacgguacaaaauaccggcccccagcgaaacuucugaaagagcgcggguuuuucggcgccaucgcaggauuuuuggagggcgggugggaaggaaugauugcugguuggcacggcuauacuucucauggggcccacggaguggcugucgccgcagaccucaaguccacccaggaggccauaaauaagaucacaaagaaccugaauagcuuaucggaacuggaggugaagaaccuccaacgacuuucuggcgcuauggacgaacugcauaaugagauuuuggagcuagaugaaaaaguagacgaucugagagcggacaccaucuccucacagauagagcucgcaguucugcuuaguaacgaagguauuaucaauagcgaggaugaacaccuguuggcccucgagaggaagcugaaaaagauguuagggccuuccgcuguggacaucggcaacggauguuucgagacuaagcacaaaugcaaucagacgugccuggaucggauugccgcaggcacauuuaacgccggggaguucucucuacccaccuuugacagccucaauaucacugcugccucacugaacgaugacggacuugauaaucauaccauuuugcuguacuauaguacagcagcguccagccucgcugucacccugaugcuugccauauucaucguguacauggucucucgugacaacgugucauguaguauuugccuguga

SEQ ID NO: 148950 - RNA, 1755 nt, Artificial Sequence
  derived and/or modified sequence opt3 from hemagglutinin__InfluenzaB__AGQ16282
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaaggaaauaacaagaaugcgacgaacccacugacuguggaggucccguauauuugugcagaaggugaggaccagaucacaguguggggcuuccauucugauaauaaaacccagaugaagaaccuguacggggacagcaauccccaacgcuuuacuuccucagccaacggagugacaacccacuaugucagucagauuggcgguuucccugaucagacggaggacgggggacucccacagagcggcagaaucguuguggauuacaugaugcaaaagcccggcaaaaccgggacaauaguauaucagaggggaguguuacugccucagaaggucuggugcgcuucuggucgguccaaagugauuaagggcucacuuccauugaucggggaagccgacugucugcaugagaaauacggaggccuaaacaagagcaaacccuacuauacuggugaacacgcaaaggcuauugggaauugcccgaucuggguuaagaccccucucaaacuggccaacggcacaaaguaccgacccccagcgaaacuucugaaggagcgcggauuuuucggcgccaucgcaggguuuuuggagggagguugggaaggcaugauugcuggguggcacggauauacuucccauggcgcccacgguguggcugucgccgcagaucucaaaucuacccaggaggccauaaauaagaucacaaagaaccugaauaguuuaagcgaacuggaggugaaaaaccuccaaagacuuucgggggcuauggacgaacugcauaaugagauuuuggagcuagacgaaaagguagaugaccugagggcggauaccaucucuucccagauagagcucgcaguucugcuuucaaacgaaggcauuaucaauagugaggacgaacaccuguuggcccucgagcggaaacugaagaaaauguuaggaccuagcgcuguggauaucggcaacggguguuucgagacuaagcacaagugcaaucagacgugccuggaccguauugccgcaggaacauuuaacgccggugaguucucccuacccaccuuugauucucucaauaucacugcugccagccugaacgacgauggccuugacaaucauaccauuuugcuguacuauucaacagcagcgaguucccucgcugucacccugaugcuugccauauucaucguguacauggucagccgcgauaacgugucuuguucaauuugccuguga

SEQ ID NO: 148951 - RNA, 1755 nt, Artificial Sequence
  derived and/or modified sequence opt3 from hemagglutinin__InfluenzaB__AGQ16283
augaaggccaucauugugcugcucauggucguuaccagcaacgcugacagaauaugcacaggcaucacuuccucuaauucaccccacgugguaaaaacggcaacccauggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccacgaaguccgcccagugaccucuggcuguuuucccauuaugcaugaccgaacaaagauccgucagcuggcaaaucuucugagagguuaugagaacauaagguugucgacucaaaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccacucugacaauaaaacacagaugaagaaccuguacggcgauagcaauccccagaaguuuaccuccucagcuaacggggugacuacacauuaugucagucaaauuggaggcuucccugaccagaccgaggauggugggcucccacagagcggacgcaucguuguggacuacaugaugcagaaacccggcaagacgggcaccauaguauaucaaagagggguguuacugccucagaaagucuggugcgccucuggaagguccaaggugauuaaagguucacuuccauugaucggcgaagcagauugucugcacgagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaagguaugauugccggcuggcauggguauacaagucacggagcucauggcguggccgucgcagccgaccucaagucuacucaggaggcuauaaauaagaucaccaaaaaccuuaauuccuuaagcgaacuggaggugaagaaccuccagcgacuuucgggugcgauggacgaacugcacaaugagauuuuggagcuagaugaaaaaguagacgaucugagagcagacacaaucucuucccaaauagagcucgccguucugcuuucaaacgaagggauuaucaauagugaggaugaacaccuguuggcucucgagaggaagcugaaaaagauguuaggcccuagcgccguggacaucggaaacggcuguuucgagaccaagcauaaaugcaaucagacuugccuggaucggauugcagccgggacguuuaacgcuggagaguucucccuacccacauuugacucucucaauaucaccgccgcaagccugaacgaugacggucuugauaaucacacuauuuugcuguacuauucaaccgcggcuaguucccucgccgucacacugaugcuugcaauauucaucguguacauggucagccgugacaacgugucuuguucaauuugccuguga

SEQ ID NO: 148952 - RNA, 1758 nt, Artificial Sequence
  derived and/or modified sequence opt3 from hemagglutinin__InfluenzaB__AGQ16284
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgaggcccgaccagucacuucuggcuguuuucccaucaugcaugaucguaccaaaauaagacaacugccuaaucuucugagggguuacgaacacaucaaguugucgacacauaacgugauuaaugcagagaacgccccagggggacccuauaaaaucggcacuucaggcagcugcccuaauguaaccaacgggaauggauucuuugcuacaauggcaugggccguuccaaagaacgacaaaaauaagaccgcuacgaacccgcucacuauugaagugcccuacaucuguacagagggugaggaucagauaaccgucuggggcuuccacagugacaaugaaacucagauggccaagcuguauggggauuccaaaccucagaaguuuacaucuagcgcgaacggagugaccacgcacuacgugucccaaauuggcgguuucccaaaccagaccgaggacgggggacugccccagucaggccggaucgucguugauuauauggugcagaaaaguggcaagacagggacuauuaccuaccaacgcggaauccucuuaccucagaaaguauggugcgcaagcgguagaucuaaggugaucaaaggcucccugccacuuauuggggaagccgacuguuugcaugagaaguauggaggccugaauaagucaaaacccuacuacacaggugagcacgcuaaggccauagggaacugcccgaucugggucaaaacuccucuaaagcucgcaaauggcaccaaauauaggcccccagcuaagcugcuuaaggaacggggauuuuucggcgccauugcgggguuucuggagggagguugggaaggcaugaucgccggguggcauggauacacaagccacggcgcacacgguguggcuguugccgcugauuugaaaaguacccaggaggccauaaacaagauuacuaaaaaucucaacucucuguccgaauuagaggugaagaaucugcagcgccucagcggggcaauggacgagcuucauaacgaaauccuggaguuggaugaaaaagucgacgaccuacgagccgauacgaucucgucucaaauugagcuggcugugcuccuguccaaugaaggcaucauuaacucagaggacgagcaccuucuggcguuggaaagaaagcucaagaaaaugcugggaccuagugcaguagagauaggcaauggguguuucgaaacaaagcauaaaugcaaccagaccugcuuagauaggaucgccgcuggaacuuuugacgccggugaguucagccugcccaccuuugauucccuaaauauuacagcagccucucucaacgacgauggccuggacaaucacaccauccuuuuguauuacagcacugcugccucaagucuggcaguuacacucaugaucgcgauuuucguggucuauauggugucccgggauaacgucagcuguucuauaugccuguga

SEQ ID NO: 148953 - RNA, 1755 nt, Artificial Sequence; identical to SEQ ID NO: 148915
  derived and/or modified sequence opt3 from hemagglutinin__InfluenzaB__AGQ16285

SEQ ID NO: 148954 - RNA, 1755 nt, Artificial Sequence; identical to SEQ ID NO: 148915
  derived and/or modified sequence opt3 from hemagglutinin__InfluenzaB__AGQ16286

SEQ ID NO: 148955 - RNA, 1755 nt, Artificial Sequence
  derived and/or modified sequence opt3 from hemagglutinin__InfluenzaB__AGQ16287
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugaagagggagaggaucagaucacagugugggguuuccauucugacaauaaaacccagaugaagaaccuguacggcgauagcaauccccaaaaguuuacuuccucagcaaacggggugacaacccacuaugucagucagauuggaggcuucccugaccagacggaagauggugggcucccacagagcggacgcaucguuguggacuacaugaugcaaaaacccggcaagaccggcacaauaguauaucagagagggguguuacugccucagaaagucuggugcgccucuggaagguccaaggugauuaaagguucacuuccauugaucggcgaggcugauugucugcaugaaaaguacgggggacuaaacaaaagcaagcccuacuauacuggcgagcacgccaaggcaauugguaauugcccgaucuggguuaaaaccccucucaagcuggcuaacgggacaaaauaccggcccccagccaagcugcugaaagagcgcggcuuuuucggagcgaucgccggcuuuuuggaagggggaugggaggguaugauugcaggcuggcacggguauacaagucauggagcucacggcguggccgucgcugccgaccucaagucuacccaggaagcaauaaauaagaucacuaaaaaccuuaauuccuuaagcgagcuggaagugaagaaccuccaacgacuuucgggugccauggacgagcugcauaaugagauuuuggaacuagaugagaaaguagacgaucugagagcugacaccaucucuucccagauagaacucgcgguucugcuuucaaacgaggggauuaucaauagugaagaugagcaccuguuggcacucgagaggaagcugaaaaagauguuaggcccuagcgccguggacaucggaaacggcuguuucgaaacuaagcacaaaugcaaucagacgugccuggaucggauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgugacaacgugucuuguucaauuugccuguga

SEQ ID NO: 148956 - RNA, 1755 nt, Artificial Sequence; identical to SEQ ID NO: 148870
  derived and/or modified sequence opt3 from hemagglutinin__InfluenzaB__AGQ16289

SEQ ID NO: 148957 - RNA, 1755 nt, Artificial Sequence; identical to SEQ ID NO: 148870
  derived and/or modified sequence opt3 from hemagglutinin__InfluenzaB__AGQ16290

SEQ ID NO: 148958 - RNA, 1755 nt, Artificial Sequence
  derived and/or modified sequence opt3 from hemagglutinin__InfluenzaB__AGQ16291
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacacaaccaguaaguccggguucuuugcaacgauggccugggcuguuccuaaagacaauaacaagaaugccacuaacccacugacaguggaggucccguauauuugugcggaaggagaggaucagaucgcagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagcccacggcguggcugucgccgcagaccucaagucuacccaggaggccauaaauaagaucacuaaaaaccuuaauuccuuaagcgaacuggaggugaagaaccuccaacgacuuucgggugcuauggacgaacugcauaaugagauuuuggagcuagaugaaaaaguagacgaucugagagcggacaccaucucuucccagauagagcucgcaguucugcuuucaaacgaagggauuaucaauagugaggaugaacaccuguuggcccucgagaggaagcugaaaaagauguuaggcccuagcgcuguggacaucggaaacggcuguuucgagacuaagcacaaaugcaaucagacgugccuggaucggauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgugacaacgugucuuguucaauuugccuguga

SEQ ID NO: 148959 - RNA, 1755 nt, Artificial Sequence
  derived and/or modified sequence opt3 from hemagglutinin__InfluenzaB__AGQ16292
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaagguaugauugccggcuggcacggguauacaagucauggagcucacggcguggccgucgcagccgaccucaagucuacucaggaggcuauaaauaagaucaccaaaaaccuuaauuccuuaagcgaacuggagauuaagaaccuccaacgacuuucgggugcgauggacgaacugcauaaugagaucuuggagcuagaugaaaaaguggacgaucugagagcagacacaauaucuucccagauugagcucgccguacugcuuucaaacgaagggaucaucaauagugaggaugaacaccuguuggcucucgagaggaagcugaaaaagauguuaggcccuagcgccguugacauuggaaacggcuguuucgagaccaagcacaaaugcaaucagacuugccuggaucggaucgcagccgggacguuuaacgcuggagaguucucccuacccacauuugacucucucaauauuaccgccgcaagccugaacgaugacggucuugauaaucauacuauauugcuguacuauucaaccgcggcuaguucccucgccgugacacugaugcuugcaaucuucauugucuacauggugagccgugacaacgucucuuguucaaucugccuguga

SEQ ID NO: 148960 - RNA, 1755 nt, Artificial Sequence; identical to SEQ ID NO: 148959
  derived and/or modified sequence opt3 from hemagglutinin__InfluenzaB__AGQ16293

SEQ ID NO: 148961 - RNA, 1755 nt, Artificial Sequence; identical to SEQ ID NO: 148959
  derived and/or modified sequence opt3 from hemagglutinin__InfluenzaB__AGQ16294

SEQ ID NO: 148962 - RNA, 1758 nt, Artificial Sequence
  derived and/or modified sequence opt3 from hemagglutinin__InfluenzaB__AGQ16295
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacugaaacaaggggcaaguuguguccgaaaugcuuaaacuguaccgaucuggacguggcucuagggcggcccaagugcacgggaaagaucccuagcgcccgcguuuccauucuccacgaggugcgaccagucacuucuggcuguuuucccaucaugcaugaucguaccaaaauaagacaacugccuaaucuucugagggguuacgaacacauccgguugucgacacauaacgugauuaaugcagagaacgccccagggggacccuauaagaucggcacuucaggcagcugcccuaauguaaccaacgggaauggauucuuugcuacaauggcaugggccguuccgaaaaacgacaagaauaaaaccgaaacgaacccacucacuauugaggugcccuacaucuguacagaggaagaggaucagauaaccgucugggguuuccacagugacaaugaaacucagauggcuaagcuguauggcgauuccaagccucagaaauuuacaucuagcgccaacggggugaccacgcacuacgugucccaaauuggaggcuucccaaaccagaccgaggacggugggcugccccagucaggacgcaucgucguugauuauauggugcagaagaguggcaaaacaggcacuauuaccuaccaaagagggauccucuuaccucagaagguauggugcgcgagcggaaggucuaaagugaucaaggguucccugccacuuauuggcgaggcagacuguuugcaugaaaaauaugggggacugaauaagucaaagcccuacuacacaggcgagcacgccaaagcuauagguaacugcccgaucugggucaagacuccucuaaaacucgccaaugggaccaaguaucggcccccagcaaaacugcuuaaggaacgcggcuuuuucggagcuauugccggcuuucuggaagggggaugggaggguaugaucgcgggcuggcauggguacacaagccacggagcccacggcguggcaguugcugccgauuugaagaguacccaggaggcuauaaacaaaauuacuaagaaucucaacucucuguccgaguuagaagugaaaaaucugcagcgacucagcggugccauggacgagcuucauaacgaaauccuggaguuggaugaaaaggucgacgaccuaagagcagauacgaucucgucucaaauugagcuggccgugcuccuguccaaugaggggaucauuaacucagaagacgagcaccuucuggcuuuggaaaggaaacucaagaagaugcugggcccuagugcgguagagauaggaaauggcuguuucgaaacaaaacauaagugcaaccagaccugcuuagaucggaucgcagccgggacuuuugacgcuggagaguucagccugcccaccuuugauucccuaaauauuacagccgcaucucucaacgacgauggucuggacaaucacaccauccuuuuguauuacagcacugccgcuucaagucuggccguuacacucaugaucgcaauuuucguggucuauauggugucccgugauaacgucagcuguucuauaugccuguga

SEQ ID NO: 148963 - RNA, 1758 nt, Artificial Sequence; identical to SEQ ID NO: 148903
  derived and/or modified sequence opt3 from hemagglutinin__InfluenzaB__AGQ16296

SEQ ID NO: 148964 - RNA, 1755 nt, Artificial Sequence; identical to SEQ ID NO: 148870
  derived and/or modified sequence opt3 from hemagglutinin__InfluenzaB__AGQ16297

SEQ ID NO: 148965 - RNA, 1755 nt, Artificial Sequence
  derived and/or modified sequence opt3 from hemagglutinin__InfluenzaB__AGQ16298
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagcccacggcguggcuauagccgcagaccucaagucuacccaggaggccaucaauaagauuacuaaaaaccuuaauuccuuaagcgaacuggaggucaagaaccuccaacgacuuucgggugcuauggacgaacugcauaaugagaucuuggagcuagaugaaaaaguggacgaucugagagcggacaccauaucuucccagauugagcucgcaguacugcuuucaaacgaagggaucaucaauagugaggaugaacaccuguuggcccucgagaggaagcugaaaaagauguuaggcccuagcgcuguugacauuggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccauauugcuguacuauucaacagcagcgaguucccucgcugugacccugaugcuugccaucuucauugucuacauggugagccgugacaacgucucuuguucaaucugccuguga

SEQ ID NO: 148966 - RNA, 1755 nt, Artificial Sequence; identical to SEQ ID NO: 148915
  derived and/or modified sequence opt3 from hemagglutinin__InfluenzaB__AGQ16299

SEQ ID NO: 148967 - RNA, 1755 nt, Artificial Sequence; identical to SEQ ID NO: 148915
  derived and/or modified sequence opt3 from hemagglutinin__InfluenzaB__AGQ16300

SEQ ID NO: 148968 - RNA, 1755 nt, Artificial Sequence; identical to SEQ ID NO: 148870
  derived and/or modified sequence opt3 from hemagglutinin__InfluenzaB__AGQ16301

SEQ ID NO: 148969 - RNA, 1755 nt, Artificial Sequence; identical to SEQ ID NO: 148870
  derived and/or modified sequence opt3 from hemagglutinin__InfluenzaB__AGQ16302

SEQ ID NO: 148970 - RNA, 1755 nt, Artificial Sequence; identical to SEQ ID NO: 148870
  derived and/or modified sequence opt3 from hemagglutinin__InfluenzaB__AGQ16303

SEQ ID NO: 148971 - RNA, 1755 nt, Artificial Sequence; identical to SEQ ID NO: 148870
  derived and/or modified sequence opt3 from hemagglutinin__InfluenzaB__AGQ16305

SEQ ID NO: 148972 - RNA, 1758 nt, Artificial Sequence
  derived and/or modified sequence opt3 from hemagglutinin__InfluenzaB__AGQ16306
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgaaacgaacccacucacuauugagguccccuacaucuguaaggagggugaagaucagauaacaguguggggcuuccacagugacaaugagacccagauggccaagcuguauggggauuccaaaccucagaaguuuacuucuagcgcuaacggagugacaacccacuacgucucccaaauuggcgguuucccaaaccagacggaagacgggggacugccccagucaggccgcaucguuguggauuauaugguacagaaaaguggcaagaccgggacaauuacuuaccaaagaggaauccucuuaccucagaaaguguggugcgccagcgguaggucuaaggucaucaaaggcucccugccacuuauuggggaggcggacuguuugcaugagaaguauggaggccugaauaagucaaaacccuacuacaccggugaacacgcaaaggccauagggaacugcccgaucugggugaaaacaccucuaaagcucgcuaauggcacuaaauaucggcccccagccaagcugcuuaaggagcgcggauuuuucggcgcaauugcuggguuucuggaaggagguugggagggcaugaucgccggguggcauggauacaccagccacggcgcgcacgguguugccguggcagcugauuugaaaaguacacaggaagccauaaacaagauuaccaaaaaucucaacucucuguccgaguuagaggucaagaaucugcagcgacucagcggggcuauggacgaacuucauaacgagauccuggaauuggaugagaaaguggacgaccuaagagccgauacuaucucgucucaaauugaacuggcaguacuccuguccaaugagggcaucauuaacucagaggacgaacaccuucuggccuuggagaggaagcucaagaaaaugcugggaccuagugcuguugaaauaggcaauggguguuucgagacgaagcauaaaugcaaccagacaugcuuagaucggaucgcggcaggaaccuuugacgccggugaguucagccugcccacuuuugauucccuaaauauuaccgcugccucucucaacgacgauggccuggacaaucacacaauccuuuuguauuacagcaccgcagccucaagucuggcugugacucucaugaucgccauuuucgucguguauauggucucccgugauaacgugagcuguucuauaugccuguga

SEQ ID NO: 148973 - RNA, 1755 nt, Artificial Sequence; identical to SEQ ID NO: 148870
  derived and/or modified sequence opt3 from hemagglutinin__InfluenzaB__AGQ16307

SEQ ID NO: 148974 - RNA, 1758 nt, Artificial Sequence; identical to SEQ ID NO: 148903
  derived and/or modified sequence opt3 from hemagglutinin__InfluenzaB__AGQ16308

SEQ ID NO: 148975 - RNA, 1755 nt, Artificial Sequence
  derived and/or modified sequence opt3 from hemagglutinin__InfluenzaB__AGQ16309
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguugcugacuacaugaugcaaaaacccggcaagaccggcacaauaguguaucagagagggguauuacugccucagaaaguguggugcgccucuggaagguccaaggucauuaaagguucacuuccauugaucggcgaagcagauugucugcaugagaaguacgggggacuaaacaaaagcaagcccuacuauacuggcgaacacgcuaaggccauugguaauugcccgaucugggugaaaaccccucucaagcuggcgaacgggacaaaauaccggcccccagccaagcugcugaaagagcgcggcuuuuucggagcaaucgcuggcuuuuuggaagggggaugggaagguaugauugccggcuggcacggguauacaagucauggagcucacggcguugccguggcagccgaccucaagucuacccaggaggcuauaaauaagaucacuaaaaaccuuaauuccuuaagcgaacuggaggucaagaaccuccaacgacuuucgggugcgauggacgaacugcauaaugagauuuuggagcuagaugaaaaaguggacgaucugagagcagacaccaucucuucccagauagagcucgccguacugcuuucaaacgaagggauuaucaauagugaggaugaacaccuguuggcucucgagaggaagcugaaaaagauguuaggcccuagcgccguugacaucggaaacggcuguuucgagacuaagcacaaaugcaaucagacgugccuggaucggauugcagccgggacauuuaacgcuggagaguucucccuacccaccuuugacucucucaauaucacugccgcaagccugaacgaugacggucuugauaaucauaccauuuugcuguacuauucaacagcggcuaguucccucgccgugacccugaugcuugcaauauucaucgucuacauggugagccgugacaacgucucuuguucaauuugccuguga

SEQ ID NO: 148976 - RNA, 1755 nt, Artificial Sequence
  derived and/or modified sequence opt3 from hemagglutinin__InfluenzaB__AGQ16310
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugguggcuggcuggcacggguauacaagucauggagcccacggcgucgcuguggccgcagaccucaagucuacccaggaggccauuaauaagauaacuaaaaaccuuaauuccuuaagcgaacuggagguaaagaaccuccaacgacuuucgggugcuauggacgaacugcauaaugagaucuuggagcuagaugaaaaaguugacgaucugagagcggacaccauuucuucccagaucgagcucgcagugcugcuuucaaacgaagggauaauuaauagugaggaugaacaccuguuggcccucgagaggaagcugaaaaagauguuaggcccuagcgcugucgacaucggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccaucuugcuguacuauucaacagcagcgaguucccucgcugugacccugaugcuugccauuuucauagucuacauggugagccgugacaacguuucuuguucaaucugccuguga

SEQ ID NO: 148977 - RNA, 1758 nt, Artificial Sequence; identical to SEQ ID NO: 148903
  derived and/or modified sequence opt3 from hemagglutinin__InfluenzaB__AGQ16311

SEQ ID NO: 148978 - RNA, 1755 nt, Artificial Sequence; identical to SEQ ID NO: 148870
  derived and/or modified sequence opt3 from hemagglutinin__InfluenzaB__AGQ16312

SEQ ID NO: 148979 - RNA, 1755 nt, Artificial Sequence
  derived and/or modified sequence opt3 from hemagglutinin__InfluenzaB__AGQ16313
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucgccgugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagaagggcuuuuucggagcaaucgcuggcuuuuuggaagggggaugggaagguaugauugccggcuggcacggguauacaagucauggagcucacggcguggccgucgcagccgaccucaagucuacucaggaggcuauaaauaaaaucaccaagaaccuuaauuccuuaagcgaacuggaggugaaaaaccuccaacgccuuucgggugcgauggacgaacugcauaaugagauuuuggagcuagaugaaaagguagacgaucugcgagcagacacaaucucuucccagauagagcucgccguucugcuuucaaacgaagggauuaucaauagugaggaugaacaccuguuggcucucgagagaaaacugaagaagauguuaggcccuagcgccguggacaucggaaacggcuguuucgagaccaaacacaagugcaaucagacuugccuggauaggauugcagccgggacguuuaacgcuggagaguucucccuacccacauuugacucucucaauaucaccgccgcaagccugaacgaugacggucuugauaaucauacuauuuugcuguacuauucaaccgcggcuaguucccucgccgucacacugaugcuugcaauauucaucguguacauggucagccgggacaacgugucuuguucaauuugccuguga

SEQ ID NO: 148980 - RNA, 1758 nt, Artificial Sequence
  derived and/or modified sequence opt3 from hemagglutinin__InfluenzaB__AGQ16314
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgaaacgaacccacucacuauugagguccccuacaucuguacagaggaagaggaucagauaaccgugugggguuuccacagugacaaugaaacucagauggccaagcuguauggcgauuccaagccucagaaauuuacaucuagcgcuaacggggugaccacgcacuacgucucccaaauuggaggcuucccaaaccagaccgaggacggugggcugccccagucaggacgcaucguuguggauuauaugguacagaagaguggcaaaacaggcacuauuaccuaccaaagagggauccucuuaccucagaagguguggugcgccagcggaaggucuaaagucaucaaggguucccugccacuuauuggcgaggcggacuguuugcaugaaaaauaugggggacugaauaagucaaagcccuacuacacaggcgagcacgcaaaagccauagguaacugcccgaucugggugaagacuccucuaaaacucgcuaaugggaccaaguaucggcccccagccaaacugcuuaaggaacgcggcuuuuucggagcaauugcuggcuuucuggaagggggaugggaggguaugaucgccggcuggcauggguacacaagccacggagcgcacggcguugccguggcagcugauuugaagaguacccaggaggccauaaacaaaauuacuaagaaucucaacucucuguccgaguuagaagucaaaaaucugcagcgacucagcggugcuauggacgagcuucauaacgaaauccuggaguuggaugaaaagguggacgaccuaagagccgauacgaucucgucucaaauugagcuggcaguacuccuguccaaugaggggaucauuaacucagaagacgagcaccuucuggccuuggaaaggaaacucaagaagaugcugggcccuagugcuguugagauaggaaauggcuguuucgaaacaaaacauaagugcaaccagaccugcuuagaucggaucgcggcagggacuuuugacgccggagaguucagccugcccaccuuugauucccuaaauauuacagcugccucucucaacgacgauggucuggacaaucacaccauccuuuuguauuacagcacugcagccucaagucuggcugugacacucaugaucgccauuuucgucguguauauggucucccgugauaacgugagcuguucuauaugccuguga

SEQ ID NO: 148981 - RNA, 1755 nt, Artificial Sequence
  derived and/or modified sequence opt3 from hemagglutinin__InfluenzaB__AGQ16315
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaccguaaucgaugccgaaaaagcuccugggggaccauaccggcucggcacaucaggcagcugccccaaugcaaccaguaaguccggguucuuugccacgauggcuugggccguuccuaaagacaacaauaagaacgcgacuaauccacugacaguggaggucccguauauuugugcagaaggagaggaucagaucaccgugugggguuuccauucugacaacaaaacucagaugaagaaucuguacggcgauagcaacccccaaaaguuuacauccucagccaaugggauuaccacgcacuaugugagucagaucggaggcuucccugaccagaccgaggauggugggcucccacagagcggacgcauagucguugacuacaugaugcaaaaacccggcaagacaggcacuauuguguaucagagagggguauuacugccucagaaaguguggugcgcuucuggaagguccaaggucaucaaagguucacuuccauugauuggcgaagccgauugucugcaugagaaguacgggggacuaaacaaaagcaagcccuacuauaccggcgaacacgcaaaggcuaucgguaacugcccgaucugggugaaaacaccucucaagcuggccaaugggacuaaauaccggcccccagcgaaacuucugaaggagcgcggcuuuuucggagccauugcaggcuuuuuggaagggggaugggaagguaugauagcuggcuggcacggguauaccagucauggagcccacggcguugcuguggccgcagaccucaagucuacacaggaggccaucaacaagauuaccaaaaaucugaacuccuuaagcgaacuggaggucaagaaucuccaacgacuuucgggugcuauggacgaacugcauaacgagaucuuggagcuagaugaaaaaguggacgaucugagagcggacacuauaucuucccagauugagcucgcaguacugcuuucaaaugaagggaucaucaacagugaggaugaacaccuguuggcccucgagaggaagcugaaaaagauguuaggcccuagcgcuguugacauuggaaauggcuguuucgagacgaagcacaaaugcaaccagacaugccuggaucggaucgccgcagggaccuuuaaugccggagaguucucccuacccacuuuugacucucucaacauuaccgcugccagccugaaugaugacggucuugauaaccauauaaucuugcuguacuauucaacagcagcgaguucccucgcugugacccugaugcuugccauuuucaucgucuacauggugagccgugacaaugucucuuguucaaucugccuguga

SEQ ID NO: 148982 - RNA, 1755 nt, Artificial Sequence; identical to SEQ ID NO: 148870
  derived and/or modified sequence opt3 from hemagglutinin__InfluenzaB__AGQ16316

SEQ ID NO: 148983 - RNA, 1755 nt, Artificial Sequence; identical to SEQ ID NO: 148870
  derived and/or modified sequence opt3 from hemagglutinin__InfluenzaB__AGQ16317

SEQ ID NO: 148984 - RNA, 1758 nt, Artificial Sequence; identical to SEQ ID NO: 148661
  derived and/or modified sequence opt3 from hemagglutinin__InfluenzaB__AGQ16318

SEQ ID NO: 148985 - RNA, 1755 nt, Artificial Sequence
  derived and/or modified sequence opt3 from hemagglutinin__InfluenzaB__AGQ16319
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaagacaaggggcaaauuguguccggggugcuuaaacuguaccgaucuggacguugcgcuaggacggcccaugugcgugggcacgacuccuagcgcuaaggccuccauccuccaugaaguccgcccagugaccucugguuguuuucccauuaugcacgaucgaacaaagauccgucaacuggcaaaucuucugagaggguaugagaacauaagguugucgacucagaauguaaucgacgccgaaaaagcuccuggaggcccauaccggcucggcaccucagggagcugccccaacgcaacaaguaaguccggauucuuugccaccauggcuugggccguuccuaaagauaauaacaagaaugcgacgaacccacugacuguggaggucccguauauuugugcagaaggugaggaccagaucgccguguggggcuuccauucugauaauaaaacacagaugaagaaccuguacggggacagcaauccccaaaaguuuaccuccucagcuaacggagugacuacacacuaugucagucagauuggcgguuucccugaucagaccgaggacgggggacucccacagagcggccgcaucguuguggauuacaugaugcaaaaacccggcaagacggggaccauaguauaucagagaggaguguuacugccucagaaagucuggugcgccucugguagguccaaggugauuaaaggcucacuuccauugaucggggaagcagacugucugcaugagaaguacggaggccuaaacaaaagcaagcccuacuauacaggugaacacgcuaaggccauugggaauugcccgaucuggguuaaaacuccucucaagcuggcgaacggcaccaaauaccggcccccagccaagcugcugaaagagcgcggauuuuucggcgcaaucgcuggguuuuuggagggagguugggaaggcaugauugccggguggcacggauauacaagucauggcgcucacgguguggccgucgcagccgaucucaagucuacucaggaggcuauaaauaagaucaccaaaaaccuuaauuccuuaagcgaacuggaggugaagaaccuccaacgacuuucgggggcgauggacgaacugcauaaugagauuuuggagcuagacgaaaaaguagaugaccugagagcagauacaaucucuucccagauagagcucgccguucugcuuucaaacgaaggcauuaucaauagugaggacgaacaccuguuggcucucgagaggaagcugaaaaagauguuaggaccuagcgccguggauaucggcaacggguguuucgagaccaagcacaaaugcaaucagacuugccuggaccggauugcagccggaacguuuaacgcuggugaguucucccuacccacauuugauucucucaauaucaccgccgcaagccugaacgacgauggccuugacaaucauacuauuuugcuguacuauucaaccgcggcuaguucccucgccgucacacugaugcuugcaauauucaucguguacauggucagccgugauaacgugucuuguucaauuugccuguga

SEQ ID NO: 148986 - RNA, 1755 nt, Artificial Sequence; identical to SEQ ID NO: 148915
  derived and/or modified sequence opt3 from hemagglutinin__InfluenzaB__AGQ16320

SEQ ID NO: 148987 - RNA, 1755 nt, Artificial Sequence; identical to SEQ ID NO: 148870
  derived and/or modified sequence opt3 from hemagglutinin__InfluenzaB__AGQ16321

SEQ ID NO: 148988 - RNA, 1755 nt, Artificial Sequence; identical to SEQ ID NO: 148870
  derived and/or modified sequence opt3 from hemagglutinin__InfluenzaB__AGQ16322

SEQ ID NO: 148989 - RNA, 1758 nt, Artificial Sequence
  derived and/or modified sequence opt3 from hemagglutinin__InfluenzaB__AGQ16323
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccagccugaaagguacugaaacaaggggcaaguuguguccgaaaugcuuaaauuguaccgaucuggacguugcgcuagggcggcccaagugcacgggaaagaucccuuccgcucgcgugucuauucuccacgagguccgaccagugacuucgggcuguuuucccaucaugcaugaucguaccaaaauaagacaacugccuaaccuucugagggguuacgaacacauccgguugucaacacauaauguaauuaacgccgaggacgcaccagggggacccuauaagaucggcacuagcggcaguugcccuaauguuaccaacgggaauggauucuuugccacaauggcuugggcagugccaaagaacgauaagaauaaaaccgccacgaacccgcucacuauugaaguccccuacaucuguacagagggugaggaccagauaaccguguggggcuuccacuccgauaaugaaacucagauggcuaagcuguauggggacucuaagccucagaaauuuacaagcuccgccaacggagugaccacgcacuacgucucacaaauuggcgguuucccaaaucagaccgaggaugggggacugccccagaguggccgcaucguuguggacuauaugguacagaaaagcggcaaaacagggacuauuaccuaccaaagaggaauccucuuaccucagaagguguggugcgcgucugguagguccaaagucaucaagggcucacugccacuuauuggggaagcagauuguuugcaugagaaauauggaggccugaacaagagcaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagucacggcgcccacgguguugcaguggcugccgacuugaagucuacccaggaggcuauaaacaaaauuacuaagaaucucaacucccugagcgaauuagaggucaaaaaucugcagcgacucucgggggccauggaugagcuucauaacgaaauccuggaguuggacgaaaagguggacgaucuaagagcagacacgaucucuucccaaauugagcuggccguacuccugucaaaugaaggcaucauuaacagugaggaugagcaccuucuggcuuuggaaaggaaacucaagaagaugcugggaccuagcgcgguugagauaggcaauggguguuucgaaacaaaacauaagugcaaccagaccugcuuagaccggaucgcagccggaacuuuugaugcuggugaguucucccugcccaccuuugacucucuaaauauuacagccgcaagccucaacgaugacggccuggauaaucacaccauccuuuuguauuacucaacugccgcuaguucccuggccgugacacucaugaucgcaauuuucgucguguauauggucagccgugacaacgugucuuguucaauaugccuguga

SEQ ID NO: 148990 - RNA, 1755 nt, Artificial Sequence; identical to SEQ ID NO: 148870
  derived and/or modified sequence opt3 from hemagglutinin__InfluenzaB__AGQ16324

SEQ ID NO: 148991 - RNA, 1755 nt, Artificial Sequence; identical to SEQ ID NO: 148870
  derived and/or modified sequence opt3 from hemagglutinin__InfluenzaB__AGQ16325

SEQ ID NO: 148992 - RNA, 1755 nt, Artificial Sequence; identical to SEQ ID NO: 148870
  derived and/or modified sequence opt3 from hemagglutinin__InfluenzaB__AGQ16326

SEQ ID NO: 148993 - RNA, 1755 nt, Artificial Sequence; identical to SEQ ID NO: 148870
  derived and/or modified sequence opt3 from hemagglutinin__InfluenzaB__AGQ16327

SEQ ID NO: 148994 - RNA, 1758 nt, Artificial Sequence
  derived and/or modified sequence opt3 from hemagglutinin__InfluenzaB__AGQ16328
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagacuccuagcgcucgcguguccauccuccacgagguccgaccagugaccucuggcuguuuucccauuaugcaugaucguacaaaaaucagacaacugccuaaucuucugagggguuacgaacacauacgguugucgacucauaacguaaucaaugccgagaacgcaccagggggacccuauaagauuggcaccucaggcagcugcccuaauguuacaaacgggaauggauucuuugccaccauggcuugggcagugccgaaaaacgacaagaauaaaacggccacuaacccacucacaaucgaaguccccuacauuuguaccgagggugaggaucagaucacuguguggggcuuccacagugacaaugaaacacagauggcuaagcuguauggggauuccaacccucagaaguuuaccucuagcgccaacggagugacgacccacuacgucucccaaauaggcgguuucccaaaucagacagaggacgggggacugccccagucaggccgcauuguuguggauuauaugguacagaaaaguggcaagacugggaccaucacauaccaaagagguauucucuuaccucagaaaguguggugcgcgagcggaaggucuaaggucaucaaaggcucccugccacuuaucggggaagcagacuguuugcaugagaaguauggaggccugaacaaaucaaagcccuacuacacuggugagcacgccaaggcuauugggaauugcccgauaugggugaaaaccccucuaaagcucgccaacggcacaaaauaucggcccccagcaaagcugcuuaaagaacgcggauuuuucggcgcuaucgccggguuucuggagggagguugggaaggcaugauugcgggguggcauggauacaccagccacggcgcccacgguguugcaguggcugccgauuugaagaguacucaggaggcuaucaauaagauaacgaaaaaccucaauucucuguccgaauuagaggucaagaaccugcagcgacucagcggggccauggacgagcuucauaaugaaauucuggaguuggaugaaaaaguggacgaccuaagagcagauacaaucucgucucaaaucgagcuggccguacuccuguccaacgaaggcauuaucaauucagaggacgagcaccuucuggcuuuggaaaggaagcucaaaaagaugcugggaccuagugcgguugagauuggcaacggguguuucgaaaccaagcauaaaugcaaucagacuugcuuagaucggauagcagccggaaccuuugacgcuggugaguucagccugcccacauuugauucccuaaacaucaccgccgcaucucucaaugacgauggccuggacaaccacacuauucuuuuguauuacagcacagccgcuucaagucuggccgugacgcucaugaucgcaaucuucgucguguauauggucucccgugauaacgugagcuguucuauuugccuguga

SEQ ID NO: 148995 - RNA, 1758 nt, Artificial Sequence
  derived and/or modified sequence opt3 from hemagglutinin__InfluenzaB__AGX15487
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguagauccaaggucaucaaaggcucacugccucuuauuggggaggcagacuguuugcaugaaaaguauggaggccugaacaagagcaaaccauacuacacaggugagcacgccaaggcuauagggaauugccccaucugggugaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguugcaguggcugccgauuugaaaucuacccaggaagcuauaaauaagauuacuaaaaaccucaauucccugagcgaguuagaagucaagaaccugcagcgccucucgggggccauggacgagcuucauaaugagauccuggaauuggaugagaaaguggacgaccuacgagcagauacgaucucuucccaaauugaacuggccguacuccugucaaacgagggcaucauuaauagugaagacgagcaccuucuggcuuuggagagaaagcucaagaaaaugcugggaccaagcgcgguugaaauaggcaacggguguuucgagacaaagcauaaaugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 148996 - RNA, 1758 nt, Artificial Sequence; identical to SEQ ID NO: 148995
  derived and/or modified sequence opt3 from hemagglutinin__InfluenzaB__AGX15496

SEQ ID NO: 148997 - RNA, 1758 nt, Artificial Sequence
  derived and/or modified sequence opt3 from hemagglutinin__InfluenzaB__AGX15518
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccgccccaacaaagagucauuucgcgaaucugaaagguaccaagacuaggggcaaauuguguccgaagugcuuaaacuguacagaucuggacguugcucuagggcggcccaagugcaccggaaauaucccuagcgccgaaguguccauucuccacgagguccgcccagugacgucuggcuguuuucccaucaugcaugaucgaacuaaaauacgucaacugccuaaccuucugagagguuacgaacacaucagguugucgacccauaauguaauuaacgcagagaaggccccagggggacccuauaaaaucggcacaucaggcagcugcccuaauguuacuaacgggaauggauucuuugcuaccauggcaugggccgugccaaagaacgacaauaacaaaacagcuaccaauagucucacgauugaagucccguacaucuguacugagggugaggaucagauaacaauuuggggcuuccacuccgacaacgaaacccagauggccaagcuguauggggauucuaagccccagaaauuuacuagcuccgcgaacggagugacaacccacuacgugucacaaaucggcgguuucccuaaucagacggaggacgggggacugccacagaguggccggauugucguugauuauauggugcagaagcccggcaaaaccgggacaaucacuuaccaacgcggaauccucuuaccucagaagguauggugcgcaagcgguagaucuaaagugauuaagggcucccugccacuuauaggggaagccgacuguuugcaugagaaauauggaggccugaacaagucaaagcccuacuacaccggugagcacgcuaaagccaucgggaauugcccgauuugggucaagacaccucuaaaacucgcaaacggcacuaaguauaggcccccagcuaaacugcuuaaggaacggggauuuuucggcgccaucgcgggguuucuggagggagguugggaaggcaugauagccggguggcauggauacaccagccacggcgcacacgguguggcuguugccgcugauuugaagaguacacaggaggccauuaauaaaaucaccaagaaccucaauucucuguccgaauuagaggugaaaaaccugcagcgccucagcucggcaauggacgagcuucauaaugaaauccuggaguuggaugaaaaggucgacgaccuacgagccgauacuauuucuucccaaaucgagcuggcugugcuccugucaaacgaagggauuauaaauagugaggacgagcaccuucuggcguuggaaagaaaacucaagaagaugcugggcccuagcgcaguagagaucggaaacggcuguuucgaaacgaaacauaagugcaaucagacaugcuuagauaggauugccgcugggaccuuugacgccggagaguucucccugcccacuuuugauucucuaaacaucaccgcagccagccucaaugacgauggucuggacaaccacacaauccuuuuguauuacucaaccgcugccaguucccuggcaguuacucucaugauugcgauauucguggucuauauggugagccgggauaacgucucuuguucaaucugccuguga

SEQ ID NO: 148998 - RNA, 1758 nt, Artificial Sequence
  derived and/or modified sequence opt3 from hemagglutinin__InfluenzaB__AGX15529
augaaggccaucauugugcugcucauggucguuaccagcaacgcugacagagugugcacaggcauaacuuccucuaauucaccccacguagugaaaacggcaacccagggggaggucaacgugacaggaguuaucccucuuacuaccacaccaaccaagagucauuucgccaaucugaaagguacuaagacaaggggcaaauuguguccgaagugcuuaaacuguaccgaucuggacguggcgcuagggcggcccaagugcacgggaaauauuccuagcgcugaagucuccauccucuacgaggugcgcccaguaacuucuggcuguuuucccauuaugcacgaucgaaccaaaauccgucaacugccuaaccuucugagagguuaugaacauauaagguugucgacacacaauguuaucaacgccgagaaggcaccagggggacccuacaaaauuggcacuucaggcagcugcccuaaugugaccaacgggaauggauucuuugccacaauggcuugggcagucccaaagaacgacaauaacaaaaccgccacgaauagucucacuaucgaagugccguauauuuguacagagggugaggaucagaucaccauauggggcuuccauuccgacaacgaaacucagauggcuaagcuguacggggauucuaagccccagaaauuuacaagcuccgccaacggagugaccacgcacuaugucucacaaauuggcgguuucccuaaucagaccgaggacgggggacugccacagaguggccggaucguuguggauuacaugguacaaaagagcggcaaaacagggacuauuaccuaucagcgcggaauccucuuaccccagaagguguggugcgcgucugguagauccaaagucaucaagggcacacugccucuuauuggggaagcagacuguuugcacgagaaauacggaggccugaacaagucaaagccauacuauacuggugagcaugccaaagcuauagggaauugccccaucugggugaagaccccgcuaaaacucgccaacggcacaaaguacaggccucccgcaaaacugcuuaaggaacggggauuuuucggcgcuauugccggguuucuggagggagguugggaaggcaugaucgcgggguggcacggauauaccagccauggcgcccacgguguugcaguggcugccgauuugaagaguacucaggaggcuauaaauaaaauuacgaagaaccucaauucucuguccgaauuagaggucaaaaaccugcagcgccucagcggggccauggacgagcuucacaaugaaauccuggaguuggaugaaaagguggacgaccuacgagcagauacaaucucgucucaaauugagcuggccguacuccuguccaacgaaggcaucauuaauucagaggacgagcaucuucuggcuuuggaaagaaaacucaagaagaugcugggaccaagugcgguugagauaggcaacggguguuucgaaaccaaacacaagugcaaucagacuugcuuagauaggaucgcagccggaaccuuugacgcuggugaguucagccugccuacauuugauucccuaaacauuaccgccgcaucucucaaugacgauggccuggacaaccauacuauccuuuuguacuauagcacagccgcuucaagucuggccgugacgcucaugaucgcaauuuucgucguguacauggucucccgggauaacgugagcuguucuauaugccuguga

SEQ ID NO: 148999 - RNA, 1758 nt, Artificial Sequence; identical to SEQ ID NO: 148589
  derived and/or modified sequence opt3 from hemagglutinin__InfluenzaB__AGX15541

SEQ ID NO: 149000 - RNA, 1758 nt, Artificial Sequence
  derived and/or modified sequence opt3 from hemagglutinin__InfluenzaB__AGX15552
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccaaaaaugcaccagggggacccuauaagaucggcacuucaggcagcugcccuaacguuaccaaugggaacggauucuuugccacaauggcuugggcagugccgaaaaaugacaacaauaagaccgccacgaacagucucacuauugaggucccauacaucuguacagaaggugaggaucagauaaccguguggggcuuccacuccgacaacgagacucagauggcuaaacuguauggggauucuaagccccagaaguuuacaagcuccgccaauggagugaccacgcacuacgucucacaaauuggcgguuucccuaaccagaccgaagacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaggcagacuguuugcaugaaaaguauggaggccugaauaaaagcaagccauacuacacaggugagcacgccaaggcuauagggaacugccccaucugggugaaaacuccgcuaaagcucgccaauggcaccaaauaucggccucccgcaaagcugcuuaaagagcgcggauuuuucggcgcuauugccggguuucuggaaggagguugggagggcaugaucgcgggguggcauggauacacaagucacggcgcccacgguguugcaguggcugccgauuugaagucuacccaggaagcuauaaacaagauuacuaaaaaucucaacucccugagcgaguuagaagucaagaaucugcagcgacucucgggggccauggacgagcuucauaacgagauccuggaauuggaugagaaaguggacgaccuaagagcagauacgaucucuucccaaauugaacuggccguacuccugucaaaugagggcaucauuaacagugaagacgagcaccuucuggcuuuggagaggaagcucaaaaagaugcugggaccaagcgcgguugaaauaggcaauggguguuucgagacaaagcauaaaugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 149001 - RNA, 1758 nt, Artificial Sequence; identical to SEQ ID NO: 148598
  derived and/or modified sequence opt3 from hemagglutinin__InfluenzaB__AGX15563

SEQ ID NO: 149002 - RNA, 1758 nt, Artificial Sequence; identical to SEQ ID NO: 148598
  derived and/or modified sequence opt3 from hemagglutinin__InfluenzaB__AGX15574

SEQ ID NO: 149003 - RNA, 1758 nt, Artificial Sequence
  derived and/or modified sequence opt3 from hemagglutinin__InfluenzaB__AGX15607
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauacuccuagcgcucgcguguccauccuccacgagguccgaccagugaccucuggcuguuuucccauuaugcaugaucguacaaagaucagacaacugccuaaccuucugagggguuacgaacacauacgguugucgacucauaauguaaucaacgccgagaaugcaccagggggacccuauaaaauuggcaccucaggcagcugcccuaacguuacaaaugggaacggauucuuugccaccauggcuugggcagugccaaagaaugacaacaauaaaacggccacuaacagucucacaaucgaagucccguacauuuguaccgagggugaggaucagaucacuguguggggcuuccacuccgacaacgaaacacagauggcuaagcuguauggggauucuaaaccccagaaguuuaccagcuccgccaauggagugacgacccacuacgucucacaaauaggcgguuucccuaaccagacagaggacgggggacugccacagaguggccgcauuguuguggauuauaugguacaaaagagcggcaaaacugggaccaucacauaccagagagguauucucuuaccccagaagguguggugcgcgucuggaagguccaaagucaucaagggcucacugccucuuaucggggaagcagacuguuugcaugagaaauauggaggccugaauaagagcaaaccauacuacacuggugagcacgccaaggcuauugggaacugccccauaugggugaagaccccgcuaaaacucgccaauggcacaaaguaucggccucccgcaaaacugcuuaaggaacgcggauuuuucggcgcuaucgccggguuucuggagggagguugggaaggcaugauugcgggguggcauggauacaccagucacggcgcccacgguguugcaguggcugccgauuugaaaucuacucaggaggcuaucaacaagauaacgaagaaucucaacucccugagcgaauuagaggucaaaaaucugcagcgacucucgggggccauggacgagcuucauaacgaaauucuggaguuggaugaaaagguggacgaccuaagagcagauacaaucucuucccaaaucgagcuggccguacuccugucaaaugaaggcauuaucaacagugaggacgagcaccuucuggcuuuggaaaggaaacucaagaaaaugcugggaccaagcgcgguugagauuggcaauggguguuucgaaaccaagcauaagugcaaccagacuugcuuagaucggauagcagccggaaccuuugacgcuggugaguucucccugccuacauuugauucucuaaauaucaccgccgcaagccucaacgacgauggccuggacaaccacacuauucuuuuguauuacucaacagccgcuaguucccuggccgugacgcucaugaucgcaaucuucgucguguauauggucagccgugauaaugugucuuguucaauuugccuguga

SEQ ID NO: 149004 - RNA, 1758 nt, Artificial Sequence
  derived and/or modified sequence opt3 from hemagglutinin__InfluenzaB__AGX15629
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaauucagauggcuaagcuguauggggauucuaaaccccagaaguuuacuagcuccgccaauggagugacaacccacuacgucucacaaaucggcgguuucccuaaccagacggaggacgggggacugccacagaguggccgcauuguuguggauuauaugguacaaaagagcggcaaaaccgggacaaucacuuaccagagaggaauccucuuaccccagaagguguggugcaccucugguagguccaaagucauuaagggcucacugccucuuauaggggaagcggacuguuugcaugagaaauauggaggccugaauaagagcaaaccauacuacacaggugagcacgcaaaggccaucgggaacugccccauuugggugaagacuccgcuaaaacucgcuaauggcaccaaguaucggccucccgccaaacugcuuaaggaacgcggauuuuucggcgcaaucgcuggguuucuggagggagguugggaaggcaugauagccggguggcauggauacacaagucacggcgcgcacgguguugccguggcagcugauuugaaaucuacccaggaggccauuaacaagaucacuaagaaucucaacucccugagcgaauuagaggucaaaaaucugcagcgacucucgggggcuauggacgagcuucauaacgaaauccuggaguuggaugaaaagguggacgaccuaagagccgauacgauuucuucccaaaucgagcuggcaguacuccugucaaaugaaggcauuauaaacagugaggacgagcaccuucuggccuuggaaaggaaacucaagaaaaugcugggaccaagcgcuguugagaucggcaauggguguuucgaaacaaagcauaagugcaaccagaccugcuuagaucggauugcggcaggaacuuuugacgccggugaguucucccugccuaccuuugauucucuaaauaucacagcugccagccucaacgacgauggccuggacaaccacaccauccuuuuguauuacucaacugcagccaguucccuggcugugacacucaugauugccauauucgucguguauauggucagccgugauaaugugucuuguucaaucugccuguga

SEQ ID NO: 149005 - RNA, 1758 nt, Artificial Sequence
  derived and/or modified sequence opt3 from hemagglutinin__InfluenzaB__AGX15651
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccuguga

SEQ ID NO: 149006 - RNA, 1758 nt, Artificial Sequence; identical to SEQ ID NO: 149005
  derived and/or modified sequence opt3 from hemagglutinin__InfluenzaB__AGX15675

SEQ ID NO: 149007 - RNA, 1758 nt, Artificial Sequence; identical to SEQ ID NO: 149005
  derived and/or modified sequence opt3 from hemagglutinin__InfluenzaB__AGX15686

SEQ ID NO: 149008 - RNA, 1758 nt, Artificial Sequence
  derived and/or modified sequence opt3 from hemagglutinin__InfluenzaB__AGX15697
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaaaccagauggcuaagcuguauggggauuccaagccucagaaauuuacuucuagcgccaacggagugacaacccacuacgugucccaaaucggcgguuucccaaaucagacggaggacgggggacugccccagucaggccgcauugucguugauuauauggugcagaagaguggcaaaaccgggacaaucacuuaccaaagaggaauccucuuaccucagaagguauggugcgcgagcgguaggucuaaagugauuaagggcucccugccacuuauaggggaagcagacuguuugcaugagaaauauggaggccugaacaagucaaagcccuacuacaccggugagcacgccaaagcuaucgggaauugcccgauuugggucaagacaccucuaaaacucgccaacggcacuaaguaucggcccccagcaaaacugcuuaaggaacgcggauuuuucggcgcuaucgccggguuucuggagggagguugggaaggcaugauagcgggguggcauggauacaccagccacggcgcccacgguguggcaguugcugccgauuugaagaguacacaggaggcuauuaauaaaaucaccaagaaccucaauucucuguccgaauuagaggugaaaaaccugcagcgacucagcggggccauggacgagcuucauaaugaaauccuggaguuggaugaaaaggucgacgaccuaagagcagauacuauuucgucucaaaucgagcuggccgugcuccuguccaacgaaggcauuauaaauucagaggacgagcaccuucuggcuuuggaaaggaaacucaagaagaugcugggaccuagugcgguagagaucggcaacggguguuucgaaacgaaacauaagugcaaucagacaugcuuagaucggauugcagccggaaccuuugacgcuggugaguucagccugcccacuuuugauucccuaaacaucaccgccgcaucucucaaugacgauggccuggacaaccacacaauccuuuuguauuacagcaccgccgcuucaagucuggccguuacucucaugauugcaauauucguggucuauauggugucccgugauaacgucagcuguucuaucugccuguga

SEQ ID NO: 149009 - RNA, 1758 nt, Artificial Sequence; identical to SEQ ID NO: 149005
  derived and/or modified sequence opt3 from hemagglutinin__InfluenzaB__AGX15708

SEQ ID NO: 149010 - RNA, 1758 nt, Artificial Sequence; identical to SEQ ID NO: 149005
  derived and/or modified sequence opt3 from hemagglutinin__InfluenzaB__AGX15719

SEQ ID NO: 149011 - RNA, 1758 nt, Artificial Sequence; identical to SEQ ID NO: 148530
  derived and/or modified sequence opt3 from hemagglutinin__InfluenzaB__AGX15730

SEQ ID NO: 149012 - RNA, 1758 nt, Artificial Sequence; identical to SEQ ID NO: 149005
  derived and/or modified sequence opt3 from hemagglutinin__InfluenzaB__AGX15741

SEQ ID NO: 149013 - RNA, 1758 nt, Artificial Sequence; identical to SEQ ID NO: 149005
  derived and/or modified sequence opt3 from hemagglutinin__InfluenzaB__AGX15753

SEQ ID NO: 149014 - RNA, 1758 nt, Artificial Sequence
  derived and/or modified sequence opt3 from hemagglutinin__InfluenzaB__AGX15764
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccauuacacucaugauagcaaucuucguuguguauauggucucccgugauaacgugagcuguucuauuugccuguga

SEQ ID NO: 149015 - RNA, 1755 nt, Artificial Sequence
  derived and/or modified sequence opt3 from hemagglutinin__InfluenzaB__AGX15775
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagauucagaugaaaaaccuguacggcgauagcaauccucaaaaguuuacuuccucagcgaacggggugacaacccacuaugucagucagaucggcagcuucccagaccagacggaggauggaggucucccccagucugggagaauaguuguggacuacaugaugcaaaagccuggaaaaaccggcacaauuguauaucagaggggcguguuacugccacagcgggucuggugcgcauccgggcgcucaaaggugaucaaaggaagccuucccuugauuggugaagccgauugucugcaugagaaguacggcgggcuaaacaaaaguaagccguacuauacuggagaacacgcuaaagccaucggcaauugcccuaucuggguuaagaccccacucaagcuggcaaacgguacaaaauaccgacccccugcuaaacuucugaaggagagaggguuuuucggcgccauugcgggauuuuuggagggcgggugggaaggaaugauagccgguuggcacggcuauacuucucauggggcacacggaguggcugucgccgcugaccucaaguccacccaggaggccaucaauaaaauuacaaagaaccugaauagcuuaucggaacuggaggugaagaaccuccaaaggcuuucuggcgcaauggacgaacugcauaaugagaucuuggagcuagaugaaaaaguagacgaucugcgggccgacaccauauccucacagauugagcucgcuguucugcuuaguaacgaagguaucaucaauagcgaggaugaacaccuguuggcgcucgagcguaagcugaaaaagauguuagggcccuccgcaguggagauuggcaacggauguuucgaaacuaaacacaagugcaaucagacgugccuggaccgcaucgccgcuggcacauuuaacgccggggaguucucucuaccaaccuuugauagccucaauauuacugcagccucacugaacgacgauggacuugacaaucauaccauauugcuguacuauaguacagcugccuccagccucgcagucacccugaugcuugcgaucuucauuguguacauggucucuagagauaacgugucauguaguaucugccuguga

SEQ ID NO: 149016 - RNA, 1758 nt, Artificial Sequence
  derived and/or modified sequence opt3 from hemagglutinin__InfluenzaB__AGX15786
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucuuucugcccaccuucgauagccuaaauaucacagccgcaucccucaacgacgauggccuggacaaucacaccauccuuuuguauuacucuacugccgcuagcucacuggccguuacacucaugauugcaauauucguggucuauauggugagucgugauaacgucuccuguagcaucugccuguga

SEQ ID NO: 149017 - RNA, 1758 nt, Artificial Sequence; identical to SEQ ID NO: 149005
  derived and/or modified sequence opt3 from hemagglutinin__InfluenzaB__AGX15797

SEQ ID NO: 149018 - RNA, 1758 nt, Artificial Sequence
  derived and/or modified sequence opt3 from hemagglutinin__InfluenzaB__AGX15808
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccaaagaacgacaagaauaaaaccgccacgaacccgcucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgaucgguaggagcaaagucauuaagggcucucugccacuuauaggggaagcagacuguuugcaugagaaauauggaggccugaauaaguccaagcccuacuacacaggugagcacgccaaagcuaucgggaacugcccgauuugggugaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaucacacggcgcccacgguguugcaguggcugccgauuugaaaagcacccaggaggcuauuaacaaaaucacuaagaaucucaacagucugucugaauuagaggucaaaaaucugcagcgacucuccggggccauggacgagcuucauaacgaaauccuggaguuggaugaaaagguggacgaccuaagagcagauacgauuagcucgcaaaucgagcuggccguacuccugucuaaugaaggcauuauaaacuccgaggacgagcaccuucuggcuuuggaaaggaaacucaagaagaugcugggaccuucagcgguugagaucggcaauggguguuucgaaacaaaacauaagugcaaccagaccugcuuagaucggauugcagccggaacuuuugacgcuggugaguucagucugcccaccuuugauagccuaaauaucacagccgcaucccucaacgacgauggccuggacaaucacaccauccuuuuguauuacucuacugccgcuagcucacuggccgugacacucaugauugcaauauucgucguguauauggucagucgugauaacguguccuguagcaucugccuguga

SEQ ID NO: 149019 - RNA, 1758 nt, Artificial Sequence; identical to SEQ ID NO: 148624
  derived and/or modified sequence opt3 from hemagglutinin__InfluenzaB__AGX15830

SEQ ID NO: 149020 - RNA, 1758 nt, Artificial Sequence; identical to SEQ ID NO: 148624
  derived and/or modified sequence opt3 from hemagglutinin__InfluenzaB__AGX15841

SEQ ID NO: 149021 - RNA, 1758 nt, Artificial Sequence; identical to SEQ ID NO: 148624
  derived and/or modified sequence opt3 from hemagglutinin__InfluenzaB__AGX15852

SEQ ID NO: 149022 - RNA, 1758 nt, Artificial Sequence; identical to SEQ ID NO: 148624
  derived and/or modified sequence opt3 from hemagglutinin__InfluenzaB__AGX15863

SEQ ID NO: 149023 - RNA, 1758 nt, Artificial Sequence
  derived and/or modified sequence opt3 from hemagglutinin__InfluenzaB__AGX15874
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggaucggaucgcagccggaacuuuugacgcuggugaguucagcuuaccaaccuuugauucccugaauauuacagccgcaucucuaaacgacgauggccucaauaaccacaccauccugcuuuauuacagcacugccgcuucaaguuuggccgugacacugaugaucgcaauuuucgucguguauauggucucccgugacaacgugagcuguucuauaugccucuga

SEQ ID NO: 149024 - RNA, 1758 nt, Artificial Sequence; identical to SEQ ID NO: 148624
  derived and/or modified sequence opt3 from hemagglutinin__InfluenzaB__AGX15885

SEQ ID NO: 149025 - RNA, 1758 nt, Artificial Sequence
  derived and/or modified sequence opt3 from hemagglutinin__InfluenzaB__AGX15896
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccgcgcacuacgucucccaaauuggcgguuuccccaaccagacggaggacgggggacugccucagucaggccgcaucguuguggauuauaugguacagaagaguggcaaaaccgggacaauuacuuaccaaagaggaauccugcucccacagaagguguggugcgcaagcgguaggucuaaagucaucaagggcuccuuaccccugauuggggaagccgacugucuucaugagaaauauggaggcuugaauaagucaaagccguacuacaccggugagcacgcuaaagccauagggaacugcccuaucugggugaagacaccccugaaacuagcaaauggcacuaaguaucggccuccagcuaaacuccugaaggaacgcggauuuuucggcgccauugcgggguuucuugagggagguugggaaggcaugaucgccggguggcauggauacaccagccacggcgcacacgguguugcuguggccgcugaucugaagaguacacaggaggccauaaacaaaauuaccaagaauuugaacucucucuccgaacuggaggucaaaaauuuacagcgacugagcggggcaauggacgagcuccauggcgaaauccuugagcuggaugaaaagguggacgacuugagagccgauacuaucucgucucaaauugagcuagcuguacugcucuccaacgaaggaaucauuaauucagaggacgagcaucugcuugcgcuggaaaggaaauugaagaagaugcucggccccagugcaguugagauagggaacggauguuucgaaacgaaacacaagugcaaucagacaugccuggaucggaucgccgcugguaccuuugacgccggcgaguucagcuuaccaacuuuugauucccugaacauuaccgcagccucucuaaaugacgaugggcucgacaaccacacaauccugcuuuauuacagcaccgcugccucaaguuuggcagugacucugaugaucgcgauuuucgucguguauauggucucccgugauaaugugagcuguucuauaugccucuga

SEQ ID NO: 149026 - RNA, 1758 nt, Artificial Sequence; identical to SEQ ID NO: 148624
  derived and/or modified sequence opt3 from hemagglutinin__InfluenzaB__AGX15907

SEQ ID NO: 149027 - RNA, 1758 nt, Artificial Sequence; identical to SEQ ID NO: 148624
  derived and/or modified sequence opt3 from hemagglutinin__InfluenzaB__AGX15918

SEQ ID NO: 149028 - RNA, 1758 nt, Artificial Sequence
  derived and/or modified sequence opt3 from hemagglutinin__InfluenzaB__AGX15929
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacaaacaauguaauuaacgccgagaaugcaccagggggacccuauaagaucggcacuucaggcagcugcccuaacguuaccaaugggaacggauucuuugccacaauggcuugggcagugccgaaaaaugacaagaacaaaaccgccacgaauccacucacuauugaaguccccuacaucuguacagagggugaggaucagauaaccguguggggcuuccauagugacaacgaaacucagauggcuaagcuguauggggauuccaagccucagaaauuuacaucuagcgccaacggagugaccacgcacuacgucucccaaauuggcgguuucccaaaucagaccgaggacgggggacugccccagucaggccgcaucguuguggauuauaugguacagaagagugagaaaacaggcacuauuaccuaccaaagagggauccucuuaccucagaagguguggugcgcgagcggaaggucuaaagucaucaaggguucccugccacuuauuggcgaagcagacuguuugcacgagaaauaugggggacugaacaagucaaagcccuacuacacaggcgaacaugccaaagcuauagguaauugcccgaucugggugaagacuccucuaaaacucgccaacgggaccaaguaucggcccccagcaaaacugcuuaaggagcgcggcuuuuucggagcuauugccggcuuucuggaagggggaugggaggguaugaucgcgggcuggcacggguacacaagccauggagcccacggcguugcaguggcugccgauuugaagaguacccaggaagcuauaaauaaaauuacuaagaaccucaauucucuguccgaguuagaggucaaaaaccugcagcgacucagcggugccauggacgaacuucacaaugagauccuggaauuggaugagaagguggacgaccuaagagcagauacgaucucgucucaaauugaacuggccguacuccuguccaacgaggggaucauuaauucagaggacgaacaucuucuggcuuuggagaggaaacucaagaagaugcugggcccuagugcgguugaaauaggaaacggcuguuucgagacaaaacacaagugcaaucagaccugcuuagaucggaucgcagccgggacuuuugacgcuggagaguucagccugcccaccuuugauucccuaaacauuacagccgcaucucucaaugacgauggucuggacaaccauaccauccuuuuguauuacagcacugccgcuucaagucuggccgugacacucaugaucgcaauuuucgucguguauauggucucccgugauaacgugagcuguucuauaugccuguga

SEQ ID NO: 149029 - RNA, 1758 nt, Artificial Sequence; identical to SEQ ID NO: 148624
  derived and/or modified sequence opt3 from hemagglutinin__InfluenzaB__AGX15940

SEQ ID NO: 149030 - RNA, 1758 nt, Artificial Sequence
  derived and/or modified sequence opt3 from hemagglutinin__InfluenzaB__AGX15962
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugaugcagaagaguggcaaaacagggacuaucaccuaccaaagagguauucucuuaccucagaagguuuggugcgcgagcggaaggucuaaagugauaaagggcucccugccacuuaucggggaagcagacuguuugcaugagaaauauggaggccugaauaagucaaagcccuacuacacaggugagcacgccaaagcuauugggaacugcccgaucuggguaaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacgguguggcagucgcugccgauuugaagaguacccaggaggcuaucaacaaaaucacuaagaaucucaacucucuguccgaauuagaggugaaaaaucugcagcgacucagcggggccauggacgagcuucauaacgaaauucuggaguuggaugaaaagguugacgaccuaagagcagauacgaucucgucucaaauugagcuggccgugcuccuguccaaugaaggcauaaucaacucagaggacgagcaccuucuggcuuuggaaaggaaacucaagaagaugcugggaccuagugcggucgagauuggcaauggguguuucgaaacaaaacauaagugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccgugacacucaugauagcaaucuucguaguuuauauggugucccgugauaacgucagcuguucuauuugccuguga

SEQ ID NO: 149031 - RNA, 1758 nt, Artificial Sequence; identical to SEQ ID NO: 148661
  derived and/or modified sequence opt3 from hemagglutinin__InfluenzaB__AGX15973

SEQ ID NO: 149032 - RNA, 1758 nt, Artificial Sequence; identical to SEQ ID NO: 148661
  derived and/or modified sequence opt3 from hemagglutinin__InfluenzaB__AGX15984

SEQ ID NO: 149033 - RNA, 1758 nt, Artificial Sequence; identical to SEQ ID NO: 148699
  derived and/or modified sequence opt3 from hemagglutinin__InfluenzaB__AGX15995

SEQ ID NO: 149034 - RNA, 1758 nt, Artificial Sequence; identical to SEQ ID NO: 148699
  derived and/or modified sequence opt3 from hemagglutinin__InfluenzaB__AGX16006

SEQ ID NO: 149035 - RNA, 1758 nt, Artificial Sequence
  derived and/or modified sequence opt3 from hemagglutinin__InfluenzaB__AGX16017
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaauucagauggcuaagcuguauggggauuccaagccucagaaauuuacuucuagcgccaacggagucacaacccacuacgugucccaaaucggcgguuucccaaaccagacggaggacgggggacugccccagucaggccgcaucguggucgauuauaugguucagaagaguggcaaaaccgggacaauuacuuaccaaagaggaauacucuuaccucagaagguguggugcgcgagcgguaggucuaaaguaaucaagggcucccugccacuuauuggggaagcagacuguuugcaugagaaauauggaggccugaauaagucaaagcccuacuacaccggugagcacgccaaagcuaucgggaacugcccgauaugggugaagacaccucuaaaacucgccaauggcacuaaguaucggcccccagcaaaacugcuuaaggaacgcggauuuuucggcgcuauugccggguuucuggagggagguugggaaggcaugaucgcgggguggcauggauacaccagccacggcgcccacggugucgcaguggcugccgauuugaagaguacacaggaggcuaucaacaaaauuaccaagaaucucaacucucuguccgaauuagagguuaaaaaucugcagcgacucagcggggccauggacgagcuucauaacgaaauccuggaguuggaugaaaagguggacgaccuaagagcagauacuauuucgucucaaauagagcuggccguccuccuguccaaugaaggcaucauuaacucagaggacgagcaccuucuggcuuuggaaaggaaacucaagaagaugcugggaccuagugcgguggagaucggcaauggguguuucgaaacgaaacauaagugcaaccagacaugcuuagaucggaucgcagccggaaccuuugacgcuggugaguucagccugcccacuuuugauucccuaaauauuaccgccgcaucucucaacgacgauggccuggacaaucacacaauacuuuuguauuacagcaccgccgcuucaagucuggccguaacucucaugaucgcaauuuucguuguguauauggucucccgugauaacgugagcuguucuaucugccuguga

SEQ ID NO: 149036 - RNA, 1755 nt, Artificial Sequence; identical to SEQ ID NO: 148442
  derived and/or modified sequence opt3 from hemagglutinin__InfluenzaB__AGX16028

SEQ ID NO: 149037 - RNA, 1755 nt, Artificial Sequence
  derived and/or modified sequence opt3 from hemagglutinin__InfluenzaB__AGX16039
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaguagacgaacugcauaaugagauuuuggagcuagaugaaaagguugacgaucugagggccgacacuaucucuucccagauagagcucgcugugcugcuuucaaacgaagggauuaucaauagugaggaugaacaccuguuggcgcucgagcggaaacugaagaaaauguuaggccccagcgcagucgacaucggaaacggcuguuucgagacgaagcacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcagugacucugaugcuugcgauauucaucgucuacauggugagccgcgacaacguuucuuguucaauuugccuguga

SEQ ID NO: 149038 - RNA, 1755 nt, Artificial Sequence
  derived and/or modified sequence opt3 from hemagglutinin__InfluenzaB__AGX16050
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauauuuguacagaaggagaggaucagaucaccgugugggguuuccauucugacaacaaaacucagaugaagaaucuguacggcgauagcaacccucaaaaauuuacauccucagcgaacggggugaccacgcacuaugucagucagauuggaggcuucccagcacagaccgaggacggugggcucccccagagcggaagaaucguuguggauuacaugguacaaaagccuaggaagacaggcacuauaguguaucagcggggcgucuuacugccacagaaaguguggugcgccucugggcgcuccaagguuauuaaaggaucacuucccuugaucggugaagcugacugucugcaugagaaguacggcgggcuaaauaaaagcaagccguacuauaccggagaacacgccaaagcaauuggcaacugcccuaucugggugaagacaccccucaagcuggcuaaugguacuaaauaccgaccuccagccaaacuucugaaggagagaggguuuuucggcgcgaucgccggauuuuuggagggcgggugggaaggaaugauugcagguuggcacggcuauaccagucauggggcucacggagucgccguggcugccgaucucaagucuacacaggaggcaauaaacaaaaucaccaagaaucugaacuccuuaagcgaacuggagguaaagaaucuccaaaggcuuucgggcgccauggacgaacugcauaacgagauuuuggagcuagacgaaaaaguugaugaccugcgggcugauacuaucucuucccagauagagcucgcggugcugcuuucaaaugaagguauuaucaacagugaggacgaacaccuguuggcacucgagcguaagcugaaaaagauguuagggcccagcgccgucgauaucggcaauggauguuucgagacgaaacacaagugcaaccagacaugccuggaccgcauugcugccggcaccuuuaaugcaggggaguucucccuaccaacuuuugauucucucaacaucaccgccgcuagccugaaugacgauggacuugacaaccauacaauuuugcuguacuauucaaccgccgcaaguucccucgcggugacucugaugcuugcuauauucaucgucuacauggugagcagagauaacguuucuuguucaauuugccuguga

SEQ ID NO: 149039 - RNA, 1755 nt, Artificial Sequence
  derived and/or modified sequence opt3 from hemagglutinin__InfluenzaB__AGX16061
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaauggacgaacugcauaaugagauuuuggagcuagaugaaaagguagacgaucugagggccgacacuaucucuucccagauagagcucgcuguucugcuuucaaacgaagggauuaucaauagugaggaugaacaccuguuggcgcucgagcggaaacugaagaaaauguuaggccccagcgcaguggacaucggaaacggcuguuucgagacgaagcacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcagucacucugaugcuugcgauauucaucguguacauggucagccgcgacaacgugucuuguucaauuugccuguga

SEQ ID NO: 149040 - RNA, 1755 nt, Artificial Sequence
  derived and/or modified sequence opt3 from hemagglutinin__InfluenzaB__AGX16083
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaggguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaauggacgaacugcauaaugagauuuuggagcuagaugaaaagguagacgaucugagggccgacacuaucucuucccagauagagcucgcuguucugcuuucaaacgaagggauuaucaauagugaggaugaacaccuguuggcgcucgagcggaaacugaagaaaauguuaggccccagcgcaguggagaucggaaacggcuguuucgaaacgaagcacaagugcaaucagacaugccuggaccguauugccgcugggaccuuuaacgccggagaguucucccuaccaacuuuugauucucucaauaucaccgcagccagccugaacgacgauggucuugacaaucauacaauuuugcuguacuauucaaccgcugccaguucccucgcagucacucugaugcuugcgauauucaucguguacauggucagccgcgauaacgugucuuguucaauuugccuguga

SEQ ID NO: 149041 - RNA, 1755 nt, Artificial Sequence
  derived and/or modified sequence opt3 from hemagglutinin__InfluenzaB__AGX16105
augaaggccaucauugugcugcucauggucguuaccagcaacgcugacagaauaugcacaggcaucacuuccucuucaaguccccacgugguaaaaacggcaacccagggggaggugaaugucacaggagugauuccucuuacuaccacaccaaccaagagcuacuucgccaaccugaaagguacuaggacacggggcaaguuguguccggauugcuuaaauuguaccgaccuggauguugcgcuagggcgccccaugugcgugggaacgacuccuuccgcuaaagccucuauccuccaugaaguccgaccagugaccucgggcuguuuucccauuaugcacgaccguacaaagaucagacaacugccuaaccuucugagggguuaugagaauauacgguugucaacucagaacguaaucgaugcagaaaaggccccagggggacccuaccgccucggcaccagcggcaguugcccuaaugcuacauccaaaucuggguucuuugcaaccauggccugggcuguuccaaaggacaacaauaaaaacgccacgaauccgcugacuguggagguccccuauauuuguacagaaggagaggaucagaucaccgugugggguuuccauagcgacaacaagacucagaugaaaaaucuguacggcgauuccaacccucaaaaguuuacaucaagugcgaauggggugaccacgcacuaugucagccagauuggaggcuucccagaccagaccgaggauggugggcucccccagucuggaagaaucguuguggacuacaugaugcaaaagccuggcaaaacaggcacuauaguauaucagaggggaguguuacugccacagaaggucuggugcgcauccgggcggucaaaagugauuaaggguagccuucccuugaucggcgaagccgauugucugcaugagaaauacgggggacuaaacaagaguaaaccguacuauaccggcgaacacgcuaaggccauugguaacugcccuaucuggguuaagacaccccucaaacuggcaaaugggacuaaguaccgcccuccagcuaaacuucugaaggagcgaggcuuuuucggagccaucgcgggcuuuuuggaagggggaugggaagguaugauugccggcuggcacggguauaccucucauggagcacacggcguggcugucgccgcugaccucaaauccacacaggaggccauaaacaagaucaccaagaaucugaacagcuuaucggaacuggaggugaaaaaucuccaaagacuuucuggugcaauggacgaacugcauuccgagauuuuggagcuagaugaaaagguagacgaucugagggccgacacuaucucaagucagauagagcucgcuguucugcuuagcaacgaagggauuaucaauuccgaggaugaacaccuguuggcgcucgagcggaaacugaagaaaauguuaggccccucugcaguggacaucggaaacggcuguuucgagacgaagcacaagugcaaucagacaugccuggaucguauugccgcugggaccuuuaacgccggagaguucagccuaccaacuuuugacucacucaauaucaccgcagccagucugaacgaugacggucuugauaaucauacaauuuugcuguacuauuccaccgcugccagcucucucgcagucacucugaugcuugcgauauucaucguguacauggucucacgcgacaacgugaguuguagcauuugccuguga

SEQ ID NO: 149042 - RNA, 1755 nt, Artificial Sequence
  derived and/or modified sequence opt3 from hemagglutinin__InfluenzaB__AGX16116
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacucagaugaagaaucuguacggcgauagcaacccucaaaaauuuacauccucagcgaacggggucaccacgcacuauguuagucagaucggaggcuucccagcacagaccgaggacggugggcucccccagagcggaagaauugugguagauuacauggugcaaaagccuaggaagacaggcacuaucgucuaucagcggggcguguuacugccacagaaaguuuggugcgccucugggcgcuccaaggugauaaaaggaucacuucccuugauuggugaagcugacugucugcaugagaaguacggcgggcuaaauaaaagcaagccguacuauaccggagaacacgccaaagcaaucggcaacugcccuauuugggucaagacaccccucaagcuggcuaaugguacuaaauaccgaccuccagccaaacuucugaaggagagaggguuuuucggcgcgaucgccggauuuuuggagggcgggugggaaggaaugaucgcagguuggcacggcuauaccagucauggggcucacggaguggccguagcugccgaucucaagucuacacaggaggcaauuaacaaaauaaccaagaaucugaacuccuuaagcgaacuggagaucaagaaucuccaaaggcuuucgggcgccauggacgaacugcauaacgagauuuuggagcuagacgaaaaaguugaugaccugcgggcugauacuaucucuucccagauagagcucgcggugcugcuuucaaaugaagguauuaucaacagugaggacgaacaccuguuggcacucgagcguaagcugaaaaagauguuagggcccagcgccgucgauaucggcaauggauguuucgagacgaaacacaagugcaaccagacaugccuggaccgcauugcugccggcaccuuuaaugcaggggaguucucccuaccaacuuuugauucucucaacaucaccgccgcuagccugaaugacgauggacuugacaaccauacaauuuugcuguacuauucaaccgccgcaaguucccucgcggugacucugaugcuugcuauauucaucgucuacauggugagcagagauaacguuucuuguucaauuugccuguga

SEQ ID NO: 149043 - RNA, 1755 nt, Artificial Sequence
  derived and/or modified sequence opt3 from hemagglutinin__InfluenzaB__AGX16127
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaauccagaugaagaaucuguacggcgauagcaacccucaaaaauuuacuuccucagcgaacggggucacaacccacuauguuagucagauuggaggcuucccagcacagacggaggacggugggcucccccagagcggaagaaucgugguagauuacauggugcaaaagccuaggaagaccggcacaauagucuaucagcggggcguguuacugccacagaaaguuuggugcgccucugggcgcuccaaggugauuaaaggaucacuucccuugaucggugaagcugacugucugcaugagaaguacggcgggcuaaauaaaagcaagccguacuauacuggagaacacgccaaagcaauuggcaacugcccuaucugggucaagacuccccucaagcuggcuaaugguacaaaauaccgaccuccagccaaacuucugaaggagagaggguuuuucggcgcgaucgccggauuuuuggagggcgggugggaaggaaugauugcagguuggcacggcuauaccagucauggggcucacggaguggccguagcugccgaucucaagucuacccaggaggcaauaaacaaaaucacaaagaaucugaacuccuuaagcgaacuggagauuaagaaucuccaaaggcuuucgggcgccauggacgaacugcauaacgagaucuuggagcuagacgaaaaaguugaugaccugcgggcugauaccauaucuucccagauugagcucgcggugcugcuuucaaaugaagguaucaucaacagugaggacgaacaccuguuggcacucgagcguaagcugaaaaagauguuagggcccagcgccgucgauauuggcaauggauguuucgagacuaaacacaagugcaaccagacgugccuggaccgcaucgcugccggcacauuuaaugcaggggaguucucccuaccaaccuuugauucucucaacauuacugccgcuagccugaaugacgauggacuugacaaccauaccauauugcuguacuauucaacagccgcaaguucccucgcggugacccugaugcuugcuaucuucauugucuacauggugagcagagauaacguuucuuguucaaucugccuguga

SEQ ID NO: 149044 - RNA, 1755 nt, Artificial Sequence; identical to SEQ ID NO: 149042
  derived and/or modified sequence opt3 from hemagglutinin__InfluenzaB__AGX16138

SEQ ID NO: 149045 - RNA, 1755 nt, Artificial Sequence; identical to SEQ ID NO: 149039
  derived and/or modified sequence opt3 from hemagglutinin__InfluenzaB__AGX16149

SEQ ID NO: 149046 - RNA, 1755 nt, Artificial Sequence; identical to SEQ ID NO: 149040
  derived and/or modified sequence opt3 from hemagglutinin__InfluenzaB__AGX16160

SEQ ID NO: 149047 - RNA, 1755 nt, Artificial Sequence; identical to SEQ ID NO: 149040
  derived and/or modified sequence opt3 from hemagglutinin__InfluenzaB__AGX16182

SEQ ID NO: 149048 - RNA, 1755 nt, Artificial Sequence; identical to SEQ ID NO: 148442
  derived and/or modified sequence opt3 from hemagglutinin__InfluenzaB__AGX16193

SEQ ID NO: 149049 - RNA, 1755 nt, Artificial Sequence; identical to SEQ ID NO: 148442
  derived and/or modified sequence opt3 from hemagglutinin__InfluenzaB__AGX16215

SEQ ID NO: 149050 - RNA, 1755 nt, Artificial Sequence; identical to SEQ ID NO: 148442
  derived and/or modified sequence opt3 from hemagglutinin__InfluenzaB__AGX16226

SEQ ID NO: 149051 - RNA, 1755 nt, Artificial Sequence
  derived and/or modified sequence opt3 from hemagglutinin__InfluenzaB__AGX16237
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaauggacgaacugcauaaugagauuuuggagcuagaugaaaagguagacgaucugagggccgacacuaucucuucccagauagagcucgcuguucugcuuucaaacgaagggauuaucaauagugaggaugaacaccuguuggcgcucgagcggaaacugaagaaaauguuaggccccagcgcaguggacaucggaaacggcuguuucgagacgaagcacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcaauaacucugaugcuugcgaucuucauugucuacauggugagccgcgacaacgucucuuguucaaucugccuguga

SEQ ID NO: 149052 - RNA, 1755 nt, Artificial Sequence; identical to SEQ ID NO: 148442
  derived and/or modified sequence opt3 from hemagglutinin__InfluenzaB__AGX16248

SEQ ID NO: 149053 - RNA, 1755 nt, Artificial Sequence; identical to SEQ ID NO: 148442
  derived and/or modified sequence opt3 from hemagglutinin__InfluenzaB__AGX16259

SEQ ID NO: 149054 - RNA, 1755 nt, Artificial Sequence
  derived and/or modified sequence opt3 from hemagglutinin__InfluenzaB__AGX16270
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcaaacggggugacaacccacuaugucagucagauuggaggcuucccugaccagacggaggauggugggcucccacagagcggaagaaucguuguggacuacaugauacaaaaacccggcaagaccggcacaauuguauaucagcgcgggguguuacugccucagaaagucuggugcgccucuggacgguccaaggugaucaaagguucacuuccauugauuggcgaagcugauugucugcaugagaaguacgggggacuaaacaaaagcaagcccuacuauacuggcgaacacgccaaggcaaucgguaauugcccgaucuggguuaaaaccccucucaagcuggcuaacgggacaaaauacaggcccccagccaagcugcugaaagagcgaggcuuuuucggagcgauugccggcuuuuuggaagggggaugggaagguaugauagcaggcuggcacggguauacaagucauggagcucacggcguggccgucgcugccgaccucaagucuacccaggaggcaaucaauaagauuacuaaaaaccuuaauuccuuaagcgaacuggaggugaagaaccuccaaagacuuucgggugccauggacgaacugcauaaugagaucuuggagcuagaugaaaaaguagacgaucugagggcugacaccauaucuucccagauugagcucgcgguucugcuuucaaacgaagggaucaucaauagugaggaugaacaccuguuggcacucgagcggaagcugaaaaagauguuaggcccuagcgccguggacauuggaaacggcuguuucgagacuaagcacaaaugcaaucagacgugccuggaucguaucgcugccgggacauuuaacgcaggagaguucucccuacccaccuuugacucucucaauauuacugccgcuagccugaacgaugacggucuugauaaucauaccauauugcuguacuauucaacagccgcaaguucccucgcggucacccugaugcuugcuaucuucauuguguacauggucagccgcgacaacgugucuuguucaaucugccuguga

SEQ ID NO: 149055 - RNA, 1755 nt, Artificial Sequence; identical to SEQ ID NO: 149054
  derived and/or modified sequence opt3 from hemagglutinin__InfluenzaB__AGX16281

SEQ ID NO: 149056 - RNA, 1755 nt, Artificial Sequence
  derived and/or modified sequence opt3 from hemagglutinin__InfluenzaB__AGX16292
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgaaucagaacguaaucgaugccgaaaaggcuccugggggaccauaccgccucggcacuucaggcagcugccccaaugcaaccaguaaauccggguucuuugccacaauggcuugggccguuccuaaggacaacaauaaaaacgcgaccaauccacugacgguggaggucccguauauuuguacugaaggagaggaucagaucacagugugggguuuccauucugacaacaagacccagaugaaaaaucuguacggcgauagcaacccccaaaaguuuacuuccucagcaaacggggugacaacccacuaugucagucagauuggaggcuucccugaccagacggaggauggugggcucccacagagcggaagaaucguuguggacuacaugaugcaaaagcccggcaaaaccggcacaauaguauaucagcgcgggguguuacugccucagaaggucuggugcgccucuggacgguccaaagugauuaagggugcccuuccauugaucggcgaagcugauugucugcaugagaaauacgggggacuaaauaagucaaaacccuacuauacuggcgaacacgcaaaggcuauugguaacugcccgaucuggguuaagaccccucucaaacuggccaaugggacaaaguacaggcccccagcgaaacuucugaaggagcgaggcuuuuucggagccaucgcaggcuuuuuggaagggggaugggaagguaugauugcuggcuggcacggguauacuagccauggagcccacggcguggcugucgccgcagaccucaaaaguacccaggaggccauaaacaagaucacaaagaaucugaacucuuuauccgaacuggaggugaaaaaucuccaaagacuuagcggugcuauggacgaacugcauaacgagauuuuggagcuagaugaaaagguagacgaucugagggcggacaccaucucgucucagauagagcucgcaguucugcuuuccaaugaagggauuaucaacucagaggaugaacaccuguuggcccucgagcggaaacugaagaaaauguuaggcccuagugcuguggacaucggaaauggcuguuucgagacuaagcacaagugcaaccagacgugccuggaucguauugccgcagggacauuuaaugccggagaguucagccuacccaccuuugacucccucaacaucacugcugccucucugaaugaugacggucuugauaaccauaccauuuugcuguacuauagcacagcagcgucaagucucgcugucacccugaugcuugccauauucaucguguacauggucucccgcgacaacgugagcuguucuauuugccuguga

SEQ ID NO: 149057 - RNA, 1758 nt, Artificial Sequence; identical to SEQ ID NO: 148530
  derived and/or modified sequence opt3 from hemagglutinin__InfluenzaB__AGX16303

SEQ ID NO: 149058 - RNA, 1755 nt, Artificial Sequence; identical to SEQ ID NO: 148442
  derived and/or modified sequence opt3 from hemagglutinin__InfluenzaB__AGX16314

SEQ ID NO: 149059 - RNA, 1755 nt, Artificial Sequence; identical to SEQ ID NO: 148442
  derived and/or modified sequence opt3 from hemagglutinin__InfluenzaB__AGX16325

SEQ ID NO: 149060 - RNA, 1755 nt, Artificial Sequence; identical to SEQ ID NO: 148747
  derived and/or modified sequence opt3 from hemagglutinin__InfluenzaB__AGX16336

SEQ ID NO: 149061 - RNA, 1755 nt, Artificial Sequence; identical to SEQ ID NO: 148747
  derived and/or modified sequence opt3 from hemagglutinin__InfluenzaB__AGX16347

SEQ ID NO: 149062 - RNA, 1755 nt, Artificial Sequence; identical to SEQ ID NO: 148747
  derived and/or modified sequence opt3 from hemagglutinin__InfluenzaB__AGX16358

SEQ ID NO: 149063 - RNA, 1755 nt, Artificial Sequence
  derived and/or modified sequence opt3 from hemagglutinin__InfluenzaB__AGX16369
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaagccuggaaaaacaggcacuauaguauaucagaggggcauuuuacugccacagaagguguggugcgcauccgggcggucaaaagucaucaagggaagccuucccuugauuggugaagccgauugucugcaugagaaauacggcgggcuaaacaagaguaaaccguacuauaccggagaacacgcuaaggccaucggcaauugcccuaucugggugaagacaccccucaaacuggcaaacgguacuaaguaccgcccuccagcuaaacuucugaaggagcgaggguuuuucggcgccauugcgggauuuuuggagggcgggugggaaggaaugauagccgguuggcacggcuauaccucucauggggcacacggaguugcuguggccgcugaccucaaauccacacaggaggccaucaauaagauuaccaagaaccugaauagcuuaucggaacuggaggucaaaaaccuccaaagacuuucuggcgcaauggacgaacugcauaaugagaucuuggagcuagaugaaaagguggacgaucugagggccgacacuauauccucacagauugagcucgcuguacugcuuaguaacgaagguaucaucaauagcgaggaugaacaccuguuggcgcucgagcggaaacugaagaaaauguuagggcccuccgcaguugagauuggcaacggauguuucgaaacgaagcacaagugcaaucagacaugccuggaccguaucgccgcuggcaccuuuaacgccggggaguucucucuaccaacuuuugauagccucaauauuaccgcagccucacugaacgacgauggacuugacaaucauacaauauugcuguacuauaguaccgcugccuccagccucgcagugacucugaugcuugcgaucuucauugucuacauggugucucgcgauaacgucucauguaguaucugccuguga

SEQ ID NO: 149064 - RNA, 1755 nt, Artificial Sequence
  derived and/or modified sequence opt3 from hemagglutinin__InfluenzaB__AGX16380
augaaggccaucgugguccugcucaugguugugaccagcaacgcugacagaauuugcacaggcauaacuuccucuaauucaccccacguagugaaaacggcaacccagggggaggucaacgugacaggaguuaucccucuuacuaccacaccaaccaagaguuacuucgccaaucugaaagguacuaggacacggggcaaguuguguccggauugcuuaaacuguaccgaccuggauguggcgcuagggcgccccaugugcgucggagcuacgccuagcgccaaagcauccauucuccaugaagugcgaccaguaacuucuggcuguuuucccaugaugcacgaccguaccaagaucagacaacugccuaaucuucugagggguuaugagaacauucgguugucgacacagaauguuaucgaugccgaaaaggcuccagggggacccuaccgccucggcacuucaggcagcugcccuaacgcaaccaguaaauccggguucuuugccacaauggcuugggccgugccaaaggacaauaacaaaaaugcgaccaacccgcugacggucgaggugcccuauauauguacugaaggagaggaucagaucacagugugggguuuccauucugacaauaagacccagaugaaaaaccuguacggcgauagcaauccucaaaaguuuacuuccucagcaaacggggucacaacccacuauguuagucagauuggcagcuucccagaccagacggaggauggaggucucccccagucugggagaaucgugguagacuacaugaugcaaaagccuggaaaaaccggcacaauuguguaucagaggggcgucuuacugccacagaagguguggugcgccuccgggcggucaaaaguuaucaagggaagccuucccuugauaggugaagcugauugucugcaugagaaauacggcgggcuaaacaagaguaaaccguacuauacuggagaacacgccaaggcaauuggcaauugcccuaucugggugaagaccccucucaaacuggcuaacgguacaaaguaccgcccacccgccaaacuucugaaggagcgaggguuuuucggcgcgauugccggauuuuuggagggcgggugggaaggaaugaucgcagguuggcacggcuauacuucucauggggcucacggagucgccguggcugccgaccucaaauccacccaggaggcaaucaauaagauuacaaagaaccugaauagcuuaucggaacuggagguuaaaaaccuccaaagacuuucuggcgccauggacgaacugcauaaugagauauuggagcuagaugaaaagguagacgaucugagggcugacaccaucuccucacagauugagcucgcggugcugcuuaguaacgaagguaucauaaauagcgaggaugaacaccuguuggcacucgagcggaaacugaagaaaauguuagggcccuccgccgucgagauuggcaacggauguuucgaaacuaagcacaagugcaaucagacgugccuggaccguaucgcugccggcacauuuaacgcaggggaguucucucuaccaaccuuugauagccucaauaucacugccgcuucacugaacgacgauggacuugacaaucauaccauuuugcuguacuauaguacagccgcauccagccucgcggugacccugaugcuugcuaucuucauugucuacauggugucucgcgauaacguuucauguaguauaugccuguga

SEQ ID NO: 149065 - RNA, 1755 nt, Artificial Sequence; identical to SEQ ID NO: 148583
  derived and/or modified sequence opt3 from hemagglutinin__InfluenzaB__AGX16391

SEQ ID NO: 149066 - RNA, 1755 nt, Artificial Sequence
  derived and/or modified sequence opt3 from hemagglutinin__InfluenzaB__AGX16402
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagccucagaugaaaaaucuguauggcgauucuaacccacaaaaguuuacuagcuccgcgaauggggugacaacccacuacgucucacagaucggagacuuccccgaucagacggaggacggcggucucccucagagugggagaauaguuguggauuauaugaugcaaaagccaggaaaaaccggcacaauuguauaccagaggggcguguuacugccccagaaggucuggugcgcaagcgggcggucuaaagugaucaagggaucccuuccguugauuggugaagccgacugucugcaugagaaauacggcgggcuaaacaagucaaaaccuuauuacacuggagaacacgcuaaggccaucggcaacugccccaucuggguuaagaccccacucaaacuggcaaaugguacaaaguaucgcccucccgcuaaacuucugaaggagcgaggguuuuucggcgccauugcgggauuuuuggagggcgggugggaaggaaugauagccgguuggcacggcuacacuagccauggggcacacggaguggcugucgccgcugaccucaaaaguacccaggaggccaucaacaagauuacaaagaaucugaacucuuuauccgaacuggaggugaaaaaucuccaaagacuuagcggcgcaauggaugaacugcauaacgagaucuuggagcuagacgaaaagguagaugaccugagggccgauaccauaucgucucagauugagcucgcuguucugcuuuccaaugaagguaucaucaacucagaggacgaacaccuguuggcgcucgagcggaaacugaagaaaauguuagggccaagugcaguggauauuggcaauggauguuucgagacuaagcacaagugcaaccagacgugccuggaccguaucgccgcuggcacauuuaaugccggggaguucagccuacccaccuuugauucccucaacauuacugcagccucucugaaugacgauggacuugacaaccauaccauauugcuguauuacagcacagcugccucaagucucgcagucacccugaugcuugcgaucuucauuguguauauggucucccgcgacaaugugagcuguucuaucugccuguga

SEQ ID NO: 149067 - RNA, 1755 nt, Artificial Sequence; identical to SEQ ID NO: 148836
  derived and/or modified sequence opt3 from hemagglutinin__InfluenzaB__AGX16413

SEQ ID NO: 149068 - RNA, 1755 nt, Artificial Sequence; identical to SEQ ID NO: 148836
  derived and/or modified sequence opt3 from hemagglutinin__InfluenzaB__AGX16423

SEQ ID NO: 149069 - RNA, 1755 nt, Artificial Sequence; identical to SEQ ID NO: 148836
  derived and/or modified sequence opt3 from hemagglutinin__InfluenzaB__AGX16434

SEQ ID NO: 149070 - RNA, 1755 nt, Artificial Sequence; identical to SEQ ID NO: 148836
  derived and/or modified sequence opt3 from hemagglutinin__InfluenzaB__AGX16445

SEQ ID NO: 149071 - RNA, 1755 nt, Artificial Sequence; identical to SEQ ID NO: 148836
  derived and/or modified sequence opt3 from hemagglutinin__InfluenzaB__AGX16456

SEQ ID NO: 149072 - RNA, 1755 nt, Artificial Sequence
  derived and/or modified sequence opt3 from hemagglutinin__InfluenzaB__AGX16467
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaagccuggaaaaacaggcacuauaguauaucagaggggcguguuacugccacagcgggucuggugcgcauccgggcgcucaaaggugauuaaaggaagccuucccuugaucggugaagccgauugucugcaugagaaguacggcgggcuaaacaaaaguaagccguacuauaccggagaacacgcuaaagccauuggcaauugcccuaucuggguuaagacaccccucaagcuggcaaacgguacuaaauaccgaccuccagcuaaacuucugaaggagagaggguuuuucggcgccaucgcgggauuuuuggagggcgggugggaaggaaugauugccgguuggcacggcuauaccucucauggggcacacggaguggcugucgccgcugaccucaaguccacacaggaggccauaaauaaaaucaccaagaaccugaauagcuuaucggaacuggaggugaagaaccuccaaaggcuuucuggcgcaauggacgaacugcauaaugagauuuuggagcuagaugaaaaaguagacgaucugcgggccgacacuaucuccucacagauagagcucgcuguucugcuuaguaacgaagguauuaucaauagcgaggaugaacaccuguuggcgcucgagcguaagcugaaaaagauguuagggcccuccgcaguggagaucggcaacggauguuucgaaacgaaacacaagugcaaucagacaugccuggaccgcauugccgcuggcaccuuuaacgccggggaguucucucuaccaacuuuugauagccucaauaucaccgcagccucacugaacgacgauggacuugacaaucauacaauuuugcuguacuauaguaccgcugccuccagccucgcagucacucugaugcuugcgauauucaucguguacauggucucuagagauaacgugucauguaguauuugccuguga

SEQ ID NO: 149073 - RNA, 1755 nt, Artificial Sequence; identical to SEQ ID NO: 148836
  derived and/or modified sequence opt3 from hemagglutinin__InfluenzaB__AGX16478

SEQ ID NO: 149074 - RNA, 1755 nt, Artificial Sequence; identical to SEQ ID NO: 148583
  derived and/or modified sequence opt3 from hemagglutinin__InfluenzaB__AGX16489

SEQ ID NO: 149075 - RNA, 1758 nt, Artificial Sequence; identical to SEQ ID NO: 148995
  derived and/or modified sequence opt3 from hemagglutinin__InfluenzaB__AGX16500

SEQ ID NO: 149076 - RNA, 1758 nt, Artificial Sequence; identical to SEQ ID NO: 148995
  derived and/or modified sequence opt3 from hemagglutinin__InfluenzaB__AGX16511

SEQ ID NO: 149077 - RNA, 1758 nt, Artificial Sequence; identical to SEQ ID NO: 148995
  derived and/or modified sequence opt3 from hemagglutinin__InfluenzaB__AGX16522

SEQ ID NO: 149078 - RNA, 1758 nt, Artificial Sequence
  derived and/or modified sequence opt3 from hemagglutinin__InfluenzaB__AGX16533
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccaaagaacgacaauaacaagaccgccacgaauagucucacuauugaggucccguacaucuguacagaaggugaggaucagauaaccguguggggcuuccacuccgacaaggagacucagauggcuaaacuguauggggauucuaagccccagaaauuuacaagcuccgccaacggagugaccacgcacuacgucucacaaauuggcgguuucccuaaccagaccgaagacgggggacugccacagaguggccggaucguuguggauuauaugguacagaaaagcggcaaaacagggacuauuaccuaccaacgcggaauccucuuaccccagaagguguggugcgcgucugguagauccaaagucaucaagggcucacugccucuuauuggggaggcagacuguuugcaugaaaaguauggaggccugaauaaaagcaagccauacuacacaggugagcacgccaaagcuauagggaacugccccaucugggugaagacuccgcuaaaacucgccaauggcaccaaguauaggccucccgcaaagcugcuuaaagagcggggauuuuucggcgcuauugccggguuucuggaaggagguugggagggcaugaucgcgggguggcauggauacacaagucacggcgcccacgguguugcaguggcugccgauuugaagucuacccaggaagcuauaaacaaaauuacuaagaaucucaacucccugagcgaguuagaagucaaaaaucugcagcgccucucgggggccauggacgagcuucauaacgagauccuggaauuggaugagaagguggacgaccuacgagcagauacgaucucuucccaaauugaacuggccguacuccugucaaaugagggcaucauuaacagugaagacgagcaccuucuggcuuuggagagaaagcucaaaaagaugcugggaccaagcgcgguugaaauaggcaauggguguuucgagacaaaacauaagugcaaccagaccugcuuagauaggaucgcagccggaacuuuugacgcuggugaguucucccugccuaccuuugauucucuaaauauuacagccgcaagccucaacgacgauggccuggacaaucacaccauccuuuuguauuacucaacugccgcuaguucccuggccgugacacucaugaucgcaauuuucgucguguauauggucagccgggauaacgugucuuguucaauaugccuguga

SEQ ID NO: 149079 - RNA, 1758 nt, Artificial Sequence
  derived and/or modified sequence opt3 from hemagglutinin__InfluenzaB__AGX16555
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgaggcucagauggccaagcuguauggggauucuaaaccccagaaguuuacuagcuccgcgaacggagugacaacccacuacgucucacaaauuggcgguuucccuaaucagacggaagacgggggacugccacagaguggccggaucguuguggauuauaugguacagaaaagcggcaagaccgggacaauuacuuaccaacgcggaauccucuuaccccagaaaguguggugcgcaucugguagauccaaggucaucaaaggcucacugccucuuauuggggaggccgacuguuugcaugaaaaguauggaggccugaacaagagcaaaccauacuacaccggugagcacgcuaaggccauagggaauugccccaucugggugaaaacaccgcuaaagcucgcaaacggcacuaaauauaggccucccgcuaagcugcuuaaggagcggggauuuuucggcgccauugcgggguuucuggaaggagguugggagggcaugaucgccggguggcauggauacaccagucacggcgcacacgguguugcuguggccgcugauuugaaaucuacacaggaagccauaaauaagauuaccaaaaaccucaauucccugagcgaguuagaagucaagaaccugcagcgccucucgggggcaauggacgagcuucauaaugagauccuggaauuggaugagaaaguggacgaccuacgagccgauacuaucucuucccaaauugaacuggcuguacuccugucaaacgagggcaucauuaauagugaagacgagcaccuucuggcguuggagagaaagcucaagaaaaugcugggaccaagcgcaguugaaauaggcaacggguguuucgagacgaagcauaaaugcaaucagacaugcuuagauaggaucgccgcuggaaccuuugacgccggugaguucucccugccuacuuuugauucucuaaacauuaccgcagccagccucaaugacgauggccuggacaaccacacaauccuuuuguauuacucaaccgcugccaguucccuggcagugacucucaugaucgcgauuuucgucguguauauggucagccgggauaacgugucuuguucaauaugccuguga

SEQ ID NO: 149080 - RNA, 1758 nt, Artificial Sequence
  derived and/or modified sequence opt3 from hemagglutinin__InfluenzaB__AGX16566
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagauucagauggcuaagcuguauggggauucuaaaccccagaaguuuacuagcuccgccaacggagugacaacccacuacgucucacaaaucggcgguuucccuaaucagacggaagacgggggacugccacagaguggccggauuguuguggauuauaugguacagaaaagcggcaagaccgggacaaucacuuaccaacgcggaauccucuuaccccagaaaguguggugcgcgucugguagauccaaggucauuaaaggcucacugccucuuauaggggaggcagacuguuugcaugaaaaguauggaggccugaacaagagcaaaccauacuacaccggugagcacgccaaggcuaucgggaauugccccauuugggugaaaacaccgcuaaagcucgccaacggcacuaaauauaggccucccgcaaagcugcuuaaggagcggggauuuuucggcgcuaucgccggguuucuggaaggagguugggagggcaugauagcgggguggcauggauacaccagucacggcgcccacgguguugcaguggcugccgauuugaaaucuacacaggaagcuauuaauaagaucaccaaaaaccucaauucccugagcgaguuagaagucaagaaccugcagcgccucucgggggccauggacgagcuucauaaugagauccuggaauuggaugagaaaguggacgaccuacgagcagauacuauuucuucccaaaucgaacuggccguacuccugucaaacgagggcauuauaaauagugaagacgagcaccuucuggcuuuggagagaaagcucaagaaaaugcugggaccaagcgcgguugaaaucggcaacggguguuucgagacgaagcauaaaugcaaucagacaugcuuagauaggauugcagccggaaccuuugacgcuggugaguucucccugccuacuuuugauucucuaaacaucaccgccgcaagccucaaugacgauggccuggacaaccacacaauccuuuuguauuacucaaccgccgcuaguucccuggccgugacucucaugauugcaauauucgucguguauauggucagccgggauaacgugucuuguucaaucugccuguga

SEQ ID NO: 149081 - RNA, 1758 nt, Artificial Sequence; identical to SEQ ID NO: 148995
  derived and/or modified sequence opt3 from hemagglutinin__InfluenzaB__AGX16577

SEQ ID NO: 149082 - RNA, 1758 nt, Artificial Sequence
  derived and/or modified sequence opt3 from hemagglutinin__InfluenzaB__AGX16588
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagauucagauggcuaagcuguauggggauucuaaaccccagaaguuuacuagcuccgccaacggagugacaacccacuacgucucacaaaucggcgguuucccuaaucagacggaagacgggggacugccacagaguggccggauuguuguggauuauaugguacagaaaagcggcaagaccgggacaaucacuuaccaacgcggaauccucuuaccccagaaaguguggugcgcgucugguagauccaaggucauuaaaggcucacugccucuuauaggggaggcagacuguuugcaugaaaaguauggaggccugaacaagagcaaaccauacuacaccggugagcacgccaaggcuaucgggaauugccccauuugggugaaaacaccgcuaaagcucgccaacggcacuaaauauaggccucccgcaaagcugcuuaaggagcggggauuuuucggcgcuaucgccggguuucuggaaggagguugggagggcaugauagcgggguggcauggauacaccagucacggcgcccacgguguugcaguggcugccgauuugaaaucuacacaggaagcuauuaauaagaucaccaaaaaccucaauucccugagcgaguuagaagucaagaaccugcagcgccucucgggggccauggacgagcuucauaaugagauccuggaauuggaugagaaaguggacgaccuacgagcagauacuauuucuucccaaaucgaacuggccguacuccugucaaacgagggcauuauaaauagugaagacgagcaccuucuggcuuuggagagaaagcucaagaaaaugcugggaccaagcgcgaucgaaauuggcaacggguguuucgagacgaagcauaaaugcaaucagacaugcuuagauaggaucgcagccggaaccuuugacgcuggugaguucucccugccuacuuuugauucucuaaacaucaccgccgcaagccucaaugacgauggccuggacaaccacacaauucuuuuguauuacucaaccgccgcuaguucccuggccguuacucucaugauagcaaucuucguggucuauauggugagccgggauaacgucucuuguucaauuugccuguga

SEQ ID NO: 149083 - RNA, 1758 nt, Artificial Sequence; identical to SEQ ID NO: 148995
  derived and/or modified sequence opt3 from hemagglutinin__InfluenzaB__AGX16599

SEQ ID NO: 149084 - RNA, 1758 nt, Artificial Sequence; identical to SEQ ID NO: 149078
  derived and/or modified sequence opt3 from hemagglutinin__InfluenzaB__AGX16610

SEQ ID NO: 149085 - RNA, 1758 nt, Artificial Sequence; identical to SEQ ID NO: 148995
  derived and/or modified sequence opt3 from hemagglutinin__InfluenzaB__AGX16621

SEQ ID NO: 149086 - RNA, 1758 nt, Artificial Sequence
  derived and/or modified sequence opt3 from hemagglutinin__InfluenzaB__AGX16654
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccauuaauagucucacgaucgaggucccauacauauguacugaaggugaggaucagauuacaguguggggcuuccacuccgacaacgagacccagauggcuaagcuguauggggauucuaaaccccagaaguuuacuagcuccgccaacggagugacaacccacuacgucucacaaaucggcgguuucccuaaucagacggaagacgggggacugccacagaguggccggauuguuguggauuauaugguacagaaaagcggcaagaccgggacaaucacuuaccaacgcggaauccucuuaccccagaaaguguggugcgcgucugguagauccaaggucauuaaaggcucacugccucuuauaggggaggcagacuguuugcaugaaaaguauggaggccugaacaagagcaaaccauacuacaccggugagcacgccaaggcuaucgggaauugccccauuugggugaaaacaccgcuaaagcucgccaacggcacuaaauauaggccucccgcaaagcugcuuaaggagcggggauuuuucggcgcuaucgccggguuucuggaaggagguugggagggcaugauagcgggguggcauggauacaccagucacggcgcccacgguguugcaguggcugccgauuugaaaucuacacaggaagcuauuaauaagaucaccaaaaaccucaauucccugagcgaguuagaagucaagaaccugcagcgccucucgggggccauggacgagcuucauaaugagauccuggaauuggaugagaaaguggacgaccuacgagcagauacuauuucuucccaaaucgaacuggccguacuccugucaaacgagggcauuauaaauagugaagacgagcaccuucuggcuuuggagagaaagcucaagaaaaugcugggaccaagcgcgaucgaaauuggcaacggguguuucgagacgaagcauaaaugcaaucagacaugcuuagauaggaucgcagccggaaccuuugacgcuggugaguucucccugccuacuuuugauucucuaaacaucaccgccgcaagccucaaugacgauggccuggacaaccacacaauucuuuuguauuacucaaccgccgcuaguucccuggccguuacucucaugauagcaaucuucguggucuauauggugagccgggauaacgucucuuguucaauuugccuguga

SEQ ID NO: 149087 - RNA, 1758 nt, Artificial Sequence; identical to SEQ ID NO: 148995
  derived and/or modified sequence opt3 from hemagglutinin__InfluenzaB__AGX16665

SEQ ID NO: 149088 - RNA, 1758 nt, Artificial Sequence; identical to SEQ ID NO: 148995
  derived and/or modified sequence opt3 from hemagglutinin__InfluenzaB__AGX16676

SEQ ID NO: 149089 - RNA, 1758 nt, Artificial Sequence; identical to SEQ ID NO: 148995
  derived and/or modified sequence opt3 from hemagglutinin__InfluenzaB__AGX16687

SEQ ID NO: 149090 - RNA, 1758 nt, Artificial Sequence; identical to SEQ ID NO: 148995
  derived and/or modified sequence opt3 from hemagglutinin__InfluenzaB__AGX16698

SEQ ID NO: 149091 - RNA, 1758 nt, Artificial Sequence
  derived and/or modified sequence opt3 from hemagglutinin__InfluenzaB__AGX16709
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacggaaaauaucccuagcgcuaaaguguccauucuccacgagguccgcccagugacuucuggauguuuucccaucaugcaugaucgaaccaagauacgucaacugccuaaccuucugagaggcuacgaacacaucagguugucgacacauaauguaauuaacgccgagaaagcaccaggugggcccuauaagaucggaacuucaggcagcugcccuaauguuaccaacggcaauggguucuuugccacaauggcuugggcagugccgaaaaacgacaauaacaagaccgccacgaauagucucacuauugaagucccauacaucuguacagagggagaggaucagauaaccgugugggguuuccacuccgacaacgaaacucagauggcuaagcuguauggcgauucuaaaccccagaaguuuacaagcuccgccaacggggugaccacgcacuacgucucacaaauuggaggcuucccuaaucagaccgaggacggugggcugccacagaguggacggaucguuguggauuauaugguacagaaaagcggcaagacaggcacuauuaccuaccaacgcgggauccucuuaccccagaaaguguggugcgcgucuggaagauccaaggucaucaaagguucacugccucuuauuggcgaagcagacuguuugcaugagaaguaugggggacugaacaagagcaaaccauacuacacaggcgagcacgccaaggcuauagguaauugccccaucugggugaaaacuccgcuaaagcucgccaacgggaccaaauauaggccucccgcaaagcugcuuaaggaacggggcuuuuucggagcuauugccggcuuucuggaagggggaugggaggguaugaucgcgggcuggcauggguacacaagucacggagcccacggcguugcaguggcugccgauuugaaaucuacccaggaggcuauaaauaagauuacuaaaaaccucaauucccugagcgaauuagaggucaagaaccugcagcgccucucgggugccauggacgagcuucauaaugaaauccuggaguuggaugaaaaaguggacgaccuacgagcagauacgaucucuucccaaauugagcuggccguacuccugucaaacgaagggaucauuaauagugaggacgagcaccuucuggcuuuggaaagaaagcucaagaaaaugcugggcccaagcgcgguugagauaggaaacggcuguuucgaaacaaagcauaaaugcaaucagaccugcuuagauaggaucgcagccgggacuuuugacgcuggagaguucucccugccuaccuuugauucucuaaacauuacagccgcaagccucaaugacgauggucuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 149092 - RNA, 1758 nt, Artificial Sequence; identical to SEQ ID NO: 148995
  derived and/or modified sequence opt3 from hemagglutinin__InfluenzaB__AGX16720

SEQ ID NO: 149093 - RNA, 1758 nt, Artificial Sequence; identical to SEQ ID NO: 148995
  derived and/or modified sequence opt3 from hemagglutinin__InfluenzaB__AGX16731

SEQ ID NO: 149094 - RNA, 1758 nt, Artificial Sequence
  derived and/or modified sequence opt3 from hemagglutinin__InfluenzaB__AGX16742
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauuauccacgaaguccgcccagugacuucuggcuguuuucccauaaugcaugaucgaaccaagauccgucaacucccuaaccugcuuagagguuacgagcacauuaggcugucgacacauaauguaaucaacgccgaaaaagcaccagggggacccuauaagauuggcacuucaggcagcugcccuaauguuaccaacgggaauggauucuuugccacaauggcuugggcagugccgaaaaacgacaauaacaagaccgccacgaauaguuugacuaucgaggucccauacauauguacagaaggugaggaucagauuaccguguggggcuuccacuccgacaacgagacucagauggcuaagcucuauggggauucuaaaccccagaaguuuacaagcuccgccaacggagugaccacgcacuacgucucacaaaucggcgguuucccuaaucagaccgaagacgggggacugccacagaguggccggauuguuguggauuauaugguacagaaaagcggcaagacagggacuaucaccuaccaacgcggaauccugcucccccagaaaguguggugcgcgucugguagauccaaggucauuaaaggcucauuaccucugauaggggaggcagacugucuucaugaaaaguauggaggcuugaacaagagcaaaccauacuacacaggugagcacgccaaggcuaucgggaauugccccauuugggugaaaacuccgcugaagcuagccaacggcaccaaauauaggccucccgcaaagcuccugaaggagcggggauuuuucggcgcuaucgccggguuucuugaaggagguugggagggcaugauagcgggguggcauggauacacaagucacggcgcccacgguguugcaguggcugccgaucugaaaucuacccaggaagcuauuaauaagaucacuaaaaaccuuaauucccucagcgagcuggaagucaagaacuuacagcgccugucgggggccauggacgagcuccauaaugagauccuugaacuggaugagaaaguggacgacuugcgagcagauacgauuucuucccaaaucgaacuagccguacugcucucaaacgagggcauuauaaauagugaagacgagcaccuguuggcucuggagagaaaguugaagaaaaugcucggaccaagcgcgguugaaaucggcaacggguguuucgagacaaagcauaaaugcaaucagaccugccuggauaggauugcagccggaacuuuugacgcuggugaguucuccuuaccuaccuuugauucucugaacaucacagccgcaagccuaaaugacgauggccucgacaaccacaccauccugcuuuauuacucaacugccgcuaguuccuuggccgugacacugaugauugcaauauucgucguguauauggucagccgggauaacgugucuuguucaaucugccucuga

SEQ ID NO: 149095 - RNA, 1758 nt, Artificial Sequence; identical to SEQ ID NO: 148995
  derived and/or modified sequence opt3 from hemagglutinin__InfluenzaB__AGX16753

SEQ ID NO: 149096 - RNA, 1758 nt, Artificial Sequence; identical to SEQ ID NO: 148995
  derived and/or modified sequence opt3 from hemagglutinin__InfluenzaB__AGX16764

SEQ ID NO: 149097 - RNA, 1758 nt, Artificial Sequence; identical to SEQ ID NO: 148995
  derived and/or modified sequence opt3 from hemagglutinin__InfluenzaB__AGX16775

SEQ ID NO: 149098 - RNA, 1758 nt, Artificial Sequence
  derived and/or modified sequence opt3 from hemagglutinin__InfluenzaB__AGX16797
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaugccuagcgcuaaaguguccauccuccacgaaguccgcccagugacuucuggcuguuuucccauuaugcaugaucgaaccaagauccgucaacugccuaaccuucugagagguuacgagcacauaagguugucgacacauaauguaaucaacgccgaaaaagcaccagggggacccuauaagauuggcacuucaggcagcugcccuaauguuaccaacgggaauggauucuuugccacaauggcuugggcagugccgaaaaacgacaauaacaagaccgccacgaauagucucacuaucgaggucccauacauuuguacagaaggugaggaucagaucaccguguggggcuuccacuccgacaacgagacucagauggcuaagcuguauggggauucuaaaccccagaaguuuacaagcuccgccaacggagugaccacgcacuacgucucacaaauaggcgguuucccuaaucagaccgaagacgggggacugccacagaguggccggauuguuguggauuauaugguacagaaaagcggcaagacagggacuaucaccuaccaacgcgguauucucuuaccccagaaaguguggugcgcgucuggaagauccaaggucaucaaaggcucacugccucuuaucggggaggcagacuguuugcaugaaaaguauggaggccugaacaagagcaaaccauacuacacaggugagcacgccaaggcuauugggaauugccccauaugggugaaaacuccgcuaaagcucgccaacggcaccaaauauaggccucccgcaaagcugcuuaaggagcggggauuuuucggcgcuaucgccggguuucuggaaggagguugggagggcaugauugcgggguggcauggauacacaagucacggcgcccacgguguugcaguggcugccgauuugaaaucuacccaggaagcuaucaauaagauaacuaaaaaccucaauucccugagcgaguuagaagucaagaaccugcagcgccucucgggggccauggacgagcuucauaaugagauucuggaauuggaugagaaaguggacgaccuacgagcagauacgaucucuucccaaaucgaacuggccguacuccugucaaacgagggcauuaucaauagugaagacgagcaccuucuggcuuuggagagaaagcucaagaaaaugcugggaccaagcgcgguugaaauuggcaacggguguuucgagacaaagcauaaaugcaaucagaccugcuuagauaggauagcagccggaacuuuugacgcuggugaguucucccugccuaccuuugauucucuaaacaucacagccgcaagccucaaugacgauggccuggacaaccacaccauucuuuuguauuacucaacugccgcuaguucccuggccgugacacucaugaucgcaaucuucgucguguauauggucagccgggauaacgugucuuguucaauuugccuguga

SEQ ID NO: 149099 - RNA, 1758 nt, Artificial Sequence; identical to SEQ ID NO: 148995
  derived and/or modified sequence opt3 from hemagglutinin__InfluenzaB__AGX16808

SEQ ID NO: 149100 - RNA, 1758 nt, Artificial Sequence
  derived and/or modified sequence opt3 from hemagglutinin__InfluenzaB__AGX16819
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacucugagacucagauggcuaagcuguauggggauagcaaaccccagaaguuuacauccucagccaacggagugaccacgcacuacgucagucaaauuggcgguuucccuaaccagaccgaagacgggggacugccacagagcggccggaucguuguggauuauaugguacagaaaucuggcaagacagggacuauuaccuaccaacgcggaauccucuuaccccagaaaguguggugcgcguccgguagaucaaaggucaucaaaggcagccugccucuuauuggggaggcagacuguuugcaugaaaaguauggaggccugaauaagaguaaaccauacuacacaggugagcacgccaaggcuauagggaacugccccaucugggugaaaacuccgcuaaagcucgccaauggcaccaaauauaggccucccgcaaagcugcuuaaggagcggggauuuuucggcgcuauugccggguuucuggaaggagguugggagggcaugaucgcgggguggcauggauacacaucucacggcgcccacgguguugcaguggcugccgauuugaaauccacccaggaagcuauaaacaagauuacuaaaaaucucaacagccugucggaguuagaagucaagaaucugcagcgccucucuggggccauggacgagcuucauaacgagauccuggaauuggaugagaaaguggacgaccuacgagcagauacgaucuccucacaaauugaacuggccguacuccugaguaaugagggcaucauuaacagcgaagacgagcaccuucuggcuuuggagagaaagcucaagaaaaugcugggaccauccgcgguugaaauaggcaauggguguuucgagacaaagcauaaaugcaaccagaccugcuuagauaggaucgcagccggaacuuuugacgcuggugaguucucucugccuaccuuugauagccuaaauauuacagccgcaucacucaacgacgauggccuggacaaucacaccauccuuuuguauuacaguacugccgcuuccagccuggccgugacacucaugaucgcaauuuucauagucuauauggugucucgggauaacgucucauguaguaucugccuguga

SEQ ID NO: 149101 - RNA, 1758 nt, Artificial Sequence; identical to SEQ ID NO: 148995
  derived and/or modified sequence opt3 from hemagglutinin__InfluenzaB__AGX16830

SEQ ID NO: 149102 - RNA, 1758 nt, Artificial Sequence
  derived and/or modified sequence opt3 from hemagglutinin__InfluenzaB__AGX16841
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggaaugaccacgcacuacgugucacaaauuggcgguuucccuaaucagaccgaagacgggggacugccacagaguggccggaucgucguugauuauauggugcagaaaagcggcaagacagggacuauuaccuaccaacgcggaauccucuuaccccagaaaguauggugcgcgucugguagauccaaggugaucaaaggcucacugccucuuauuggggaggcagacuguuugcaugaaaaguauggaggccugaacaagagcaaaccauacuacacaggugagcacgccaaggcuauagggaauugccccaucugggucaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguggcaguugcugccgauuugaaaucuacccaggaagcuauaaauaagauuacuaaaaaccucaauucccugagcgaguuagaagugaagaaccugcagcgccucucgggggccauggacgagcuucauaaugagauccuggaauuggaugagaaagucgacgaccuacgagcagauacgaucucuucccaaauugaacuggccgugcuccugucaaacgagggcaucauuaauagugaagacgagcaccuucuggcuuuggagagaaagcucaagaaaaugcugggaccaagcgcgguagaaauaggcaacggguguuucgagacaaagcauaaaugcaaucagaccugcuuagauaggaucgcagccggaacuuuugacgcuggugaguucucccugccuaccuuugauucucuaaacauuacagccgcaagccucaauggcgacgggcuggauaaccacaccauccuuuuguauuacucaacugccgcuaguucccuggccguuacacucaugaucgcaauuuucguggucuauauggugagccgggacaacgucucuuguucaauaugccuguga

SEQ ID NO: 149103 - RNA, 1758 nt, Artificial Sequence
  derived and/or modified sequence opt3 from hemagglutinin__InfluenzaB__AGX16852
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguagauccaaggucaucaaaggcucacugccucuuauuggggaggcagacuguuugcaugaaaaguauggaggccugaacaagagcaaaccauacuacacaggugagcacgccaaggcuauagggaauugccccaucugggugaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguugcaguggcugccgauuugaaaucuacccaggaagcuauaaauaagauuacuaaaaaccucaauucccugagcgaguuagaagucaagaaccugcagcgcaucucgggggccauggacgagcuccauaaugagauccuugaacuggaugagaaaguggacgacuugcgagcagauacgauuucuucccaaaucgaacuagccguacugcucucaaacgagggcauuauaaauagugaagacgagcaucugcuugcucuggagagaaaguugaagaaaaugcucggaccaagcgcgguugaaaucggcaacggguguuucgagacaaagcacaaaugcaaucagaccugccuggauaggauugcagccggaacuuuugacgcuggugaguucuccuuaccuaccuuugauucucugaacaucacagccgcaagccuaaaugacgauggccucgacaaccacaccauccugcuuuauuacucaacugccgcuaguuccuuggccgugacacugaugauugcaauauucgucguguauauggucagccgggauaacgugucuuguucaaucugccucuga

SEQ ID NO: 149104 - RNA, 1758 nt, Artificial Sequence; identical to SEQ ID NO: 148995
  derived and/or modified sequence opt3 from hemagglutinin__InfluenzaB__AGX16863

SEQ ID NO: 149105 - RNA, 1758 nt, Artificial Sequence; identical to SEQ ID NO: 148995
  derived and/or modified sequence opt3 from hemagglutinin__InfluenzaB__AGX16874

SEQ ID NO: 149106 - RNA, 1758 nt, Artificial Sequence
  derived and/or modified sequence opt3 from hemagglutinin__InfluenzaB__AGX16885
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguagauccaaggucaucaaaggcucacugccucuuauuggggaggcagacuguuugcaugaaaaguauggaggccugaacaagagcaaaccauacuacacaggugagcacgccaaggcuauagggaauugccccaucugggugaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguugcaguggcugccgauuugaaaucuacccaggaagcuauaaauaagauuacuaaaaaccucaauucccugagcgaguuagaagucaagaaccugcagcgccucucgggggccauggacgagcuucauaaugagauccuggaauuggaugagaaaguggacgaccuacgagcagauacgaucucuucccaaauugaacuggccguacuccugucaaacgagggcaucauuaauagugaagacgagcaccuucuggcuuuggagagaaagcucaagaaaaugcugggaccaagcgcgauagaaaucggcaacggguguuucgagacaaagcauaaaugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgggauaacgucucuuguucaaucugccuguga

SEQ ID NO: 149107 - RNA, 1758 nt, Artificial Sequence; identical to SEQ ID NO: 149106
  derived and/or modified sequence opt3 from hemagglutinin__InfluenzaB__AGX16896

SEQ ID NO: 149108 - RNA, 1758 nt, Artificial Sequence; identical to SEQ ID NO: 148995
  derived and/or modified sequence opt3 from hemagglutinin__InfluenzaB__AGX16907

SEQ ID NO: 149109 - RNA, 1758 nt, Artificial Sequence; identical to SEQ ID NO: 149080
  derived and/or modified sequence opt3 from hemagglutinin__InfluenzaB__AGX16918

SEQ ID NO: 149110 - RNA, 1758 nt, Artificial Sequence; identical to SEQ ID NO: 148995
  derived and/or modified sequence opt3 from hemagglutinin__InfluenzaB__AGX16940

SEQ ID NO: 149111 - RNA, 1758 nt, Artificial Sequence; identical to SEQ ID NO: 149106
  derived and/or modified sequence opt3 from hemagglutinin__InfluenzaB__AGX16951

SEQ ID NO: 149112 - RNA, 1758 nt, Artificial Sequence
  derived and/or modified sequence opt3 from hemagglutinin__InfluenzaB__AGX16962
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccgaaagucauuucgccaaucugaaggguacuaaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaaggaggacgggggacugccacagaguggccggaucguuguggauuauaugguacagaaaagcggcaacaccgggacaauuacuuaccaacgcggaauccucuuaccccagaagguguggugcgcgucugguagauccaaagucaucaagggcucacugccucuuauuggggaagcagacuguuugcaugagaaauauggaggccugaauaagagcaagccauacuacaccggugagcacgccaaagcuauagggaacugccccaucugggugaagacaccgcuaaaacucgccaauggcacuaaguauaggccucccgcaaaacugcuuaaggaacggggauuuuucggcgcuauugccggguuucuggagggagguugggaaggcaugaucgcgggguggcauggauacaccagucacggcgcccacgguguugcaguggcugccgauuugaagucuacacaggaggcuauaaacaaaauuaccaagaaucucaacucccugagcgaauuagaggucaaaaaucugcagcgccucucgggggccauggacgagcuucauaacgaaauccuggaguuggaugaaaagguggacgaccuacgagcagauacuaucucuucccaaauugagcuggccguacuccugucaaaugaaggcaucauuaacagugaggacgagcaccuucuggcuuuggaaagaaaacucaagaagaugcugggaccaagcgcgguugagauaggcaauggguguuucgaaacgaaacauaagugcaaccagacaugcuuagauaggaucgcagccggaaccuuugacgcuggugaguucucccugccuacuuuugauucucuaaauauuaccgccgcaagccucaacgacgauggccuggacaaccacacaauccuuuuguauuacucaaccgccgcuaguucccuggccgugacucucaugaucgcaauuuucgucguguauauggucagccgggauaaugugucuuguucaauaugccuguga

SEQ ID NO: 149113 - RNA, 1758 nt, Artificial Sequence; identical to SEQ ID NO: 148995
  derived and/or modified sequence opt3 from hemagglutinin__InfluenzaB__AGX16973

SEQ ID NO: 149114 - RNA, 1758 nt, Artificial Sequence
  derived and/or modified sequence opt3 from hemagglutinin__InfluenzaB__AGX16995
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacugucgaggugccauacauuuguacagaaggugaggaucagaucaccguguggggcuuccacuccgacaacgagauacagauggcuaagcuguauggggauucuaaaccccagaaguuuacuagcuccgccaacggagucacaacccacuacguuucacaaauuggcgguuucccuaaucagacggaagacgggggacugccacagaguggccggaucgugguagauuauauggugcagaaaagcggcaagaccgggacaauuacuuaccaacgcggaauccucuuaccccagaaagucuggugcgcgucugguagauccaaggugaucaaaggcucacugccucuuauuggggaggcagacuguuugcaugaaaaguauggaggccugaacaagagcaaaccauacuacaccggugagcacgccaaggcuauagggaauugccccaucuggguuaaaacaccgcuaaagcucgccaacggcacuaaauauaggccucccgcaaagcugcuuaaggagcggggauuuuucggcgcuauugccggguuucuggaaggagguugggagggcaugaucgcgggguggcauggauacaccagucacggcgcccacgguguggcagucgcugccgauuugaaaucuacacaggaagcuauaaauaagauuaccaaaaaccucaauucccugagcgaguuagaagugaagaaccugcagcgccucucgggggccauggacgagcuucauaaugagauccuggaauuggaugagaaaguagacgaccuacgagcagauacuaucucuucccaaauugaacuggccguucuccugucaaacgagggcaucauuaauagugaagacgagcaccuucuggcuuuggagagaaagcucaagaaaaugcugggaccaagcgcgguggaaauaggcaacggguguuucgagacgaagcauaaaugcaaucagacaugcuuagauaggaucgcagccggaaccuuugacgcuggugaguucucccugccuacuuuugauucucuaaacauuaccgccgcaagccucaaugacgauggccuggacaaccacacaauccuuuuguauuacucaaccgccgcuaguucccuggccgucacucucaugaucgcaauuuucguggucuauauggugagccgggauaacguuucuuguucaauaugccuguga

SEQ ID NO: 149115 - RNA, 1758 nt, Artificial Sequence
  derived and/or modified sequence opt3 from hemagglutinin__InfluenzaB__AGX17006
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagaaccagauggcuaagcuguauggggauucuaaaccccagaaguuuacuagcuccgccaauggagugacaacccacuacgucucacaaauuggcgguuucccuaaccagacggaagacgggggacugccacagaguggccggaucguuguggauuauaugguacagaaaagcggcaagaccgggacaauuacuuaccaacgcggaauccucuuaccccagaaaguguggugcgcgucugguagauccaaggucaucaaaggcucacugccucuuauuggggaggcagacuguuugcaugaaaaguauggaggccugaauaagagcaaaccauacuacaccggugagcacgccaaggcuauagggaacugccccaucugggugaaaacaccgcuaaagcucgccaauggcacuaaauauaggccucccgcaaagcugcuuaaggagcggggauuuuucggcgcuauugccggguuucuggaaggagguugggagggcaugaucgcgggguggcauggauacaccagucacggcgcccacgguguugcaguggcugccgauuugaaaucuacacaggaagcuauaaacaagauuaccaaaaaucucaacucccugagcgaguuagaagucaagaaucugcagcgccucucgggggccauggacgagcuucauaacgagauccuggaauuggaugagaaaguggacgaccuacgagcagauacuaucucuucccaaauugaacuggccguacuccugucaaaugagggcaucauuaacagugaagacgagcaccuucuggcuuuggagagaaagcucaagaaaaugcugggaccaagcgcgguugaaauaggcaauggguguuucgagacgaagcauaaaugcaaccagacaugcuuagauaggaucgcagccggaaccuuugacgcuggugaguucucccugccuacuuuugauucucuaaauauuaccgccgcaagccucaacgacgauggccuggacaaccacacaauccuuuuguauuacucaaccgccgcuaguucccuggccgugacucucaugaucgcaauuuucgucguguauauggucagccgggauaaugugucuuguucaauaugccuguga

SEQ ID NO: 149116 - RNA, 1758 nt, Artificial Sequence; identical to SEQ ID NO: 148995
  derived and/or modified sequence opt3 from hemagglutinin__InfluenzaB__AGX17017

SEQ ID NO: 149117 - RNA, 1758 nt, Artificial Sequence; identical to SEQ ID NO: 148995
  derived and/or modified sequence opt3 from hemagglutinin__InfluenzaB__AGX17028

SEQ ID NO: 149118 - RNA, 1758 nt, Artificial Sequence
  derived and/or modified sequence opt3 from hemagglutinin__InfluenzaB__AGX17039
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccgaaagucauuucgccaaucugaaggguacuaaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaacacagggacuauuaccuaccagcgcggaauccucuuaccccagaaaguguggugcgcgucugguagauccaaggucaucaaaggcucacugccucuuauuggggaagcagacuguuugcaugagaaguauggaggccugaauaaaagcaagccauacuacacaggugagcacgccaaggcuauagggaacugccccaucugggugaaaacuccgcuaaagcucgccaauggcaccaaauauaggccucccgcaaagcugcuuaaagaacggggauuuuucggcgcuauugccggguuucuggagggagguugggaaggcaugaucgcgggguggcauggauacacaagucacggcgcccacgguguugcaguggcugccgauuugaagucuacccaggaggcuauaaacaagauuacuaaaaaucucaacucccugagcgaauuagaggucaagaaucugcagcgccucucgggggccauggacgagcuucauaacgaaauccuggaguuggaugaaaaaguggacgaccuacgagcagauacgaucucuucccaaauugagcuggccguacuccugucaaaugaaggcaucauuaacagugaggacgagcaccuucuggcuuuggaaagaaagcucaaaaagaugcugggaccaagcgcgguugagauaggcaauggguguuucgaaacaaagcauaaaugcaaccagaccugcuuagauaggaucgcagccggaacuuuugacgcuggugaguucucccugccuaccuuugauucucuaaauauuacagccgcaagccucaacgacgauggccuggacaaccacaccaucaugcuuuauuacucaacugccgcuaguuccuuggccgugacacugaugaucgcaauuuucgucguguauauggucagccgggauaaugugucuuguucaauaugccucuga

SEQ ID NO: 149119 - RNA, 1758 nt, Artificial Sequence; identical to SEQ ID NO: 148995
  derived and/or modified sequence opt3 from hemagglutinin__InfluenzaB__AGX17050

SEQ ID NO: 149120 - RNA, 1758 nt, Artificial Sequence
  derived and/or modified sequence opt3 from hemagglutinin__InfluenzaB__AGX17061
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagaggauccgguugucgaaucacaacguaauuaaugccgaaaaagcaccagggggacccuauaagaucggcacaucaggcagcugcccuaacguuacuaaugggaacggauucuuugccaccauggcuugggcagugccgaaaaaugagaacaauaagacagccaccaacagucucacgauugaagucccauacaucuguacugagggugaggaccagauaacaguguggggcuuccauuccgauaacgaaacccagauggcuaagcuguauggggacucuaaaccccagaaguuuacuagcuccgccaauggagugacaacccacuacgucucacaaauuggcgguuucccuaaccagacggaggaugggggacugccacagaguggccgcaucguuguggacuauaugguacagaaaagcggcaagaccgggacaauuacuuaccaaagaggaauccucuuaccccagaaaguguggugcgcgucugguagguccaaggucaucaaaggcucacugccucuuauuggggaagcagauuguuugcacgagaaguauggaggccugaauaagagcaaaccauacuacaccggugagcaugccaaggcuauagggaacugccccaucugggugaaaacaccgcuaaagcucgccaauggcacuaaauaucggccucccgcaaagcugcuuaaggaacgcggauuuuucggcgcuauugccggguuucuggagggagguugggaaggcaugaucgcgggguggcacggauacaccagucauggcgcccacgguguugcaguggcugccgacuugaaaucuacacaggaggcuauaaacaagauuaccaaaaaucucaacucccugagcgaauuagaggucaagaaucugcagcgacucucgggggccauggaugagcuucacaacgaaauccuggaguuggacgaaaaaguggaugaccuaagagcagacacuaucucuucccaaauugagcuggccguacuccugucaaaugaaggcaucauuaacagugaggaugagcaucuucuggcuuuggaaaggaagcucaagaaaaugcugggaccaagcgcgguugagauaggcaauggguguuucgaaacgaagcacaaaugcaaccagacaugcuuagaccggaucgcagccggaaccuuuaaugcuggugaguucucccugccuacuuuugauucucuaaacauuaccgccgcaagccucaacgacgauggccuggacaaucauacaauccuuuuguauuacucaaccgccgcuaguucccuggccgugacucucaugaucgcaauuuucgucguguauauggucagccgugauaacgugucuuguucaauaugccuguga

SEQ ID NO: 149121 - RNA, 1758 nt, Artificial Sequence
  derived and/or modified sequence opt3 from hemagglutinin__InfluenzaB__AGX17072
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccgaaagucauuucgccaaucugaaggguacuaaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaacacagggacuauuaccuaccagcgcggaauccucuuaccccagaaaguguggugcgcgucugguagauccaaggucaucaaaggcucacugccucuuauuggggaagcagacuguuugcaugagaaguauggaggccugaauaaaagcaagccauacuacacaggugagcacgccaaggcuauagggaacugccccaucugggugaaaacuccgcuaaagcucgccaauggcaccaaauauaggccucccgcaaagcugcuuaaagaacggggauuuuucggcgcuauugccggguuucuggagggagguugggaaggcaugaucgcgggguggcauggauacacaagucacggcgcccacgguguugcaguggcugccgauuugaagucuacccaggaggcuauaaacaagauuacuaaaaaucucaacucccugagcgaauuagaggucaagaaucugcagcgccucucgggggccauggacgagcuucauaacgaaauccuggaguuggaugaaaaaguggacgaccuacgagcagauacgaucucuucccaaauugagcuggccguacuccugucaaaugaaggcaucauuaacagugaggacgagcaccuucuggcuuuggaaagaaagcucaaaaagaugcugggaccaagcgcgguugagauaggcaauggguguuucgaaacaaagcauaaaugcaaccagaccugcuuagauaggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgggauaaugugucuuguucaauaugccuguga

SEQ ID NO: 149122 - RNA, 1758 nt, Artificial Sequence; identical to SEQ ID NO: 149106
  derived and/or modified sequence opt3 from hemagglutinin__InfluenzaB__AGX17083

SEQ ID NO: 149123 - RNA, 1758 nt, Artificial Sequence
  derived and/or modified sequence opt3 from hemagglutinin__InfluenzaB__AGX17094
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacucugagacucagauggcuaagcuguauggggauagcaaaccccagaaguuuacauccucagccaacggagugaccacgcacuacgucagucaaauuggcgguuucccuaaccagaccgaagacgggggacugccacagagcggccggaucguuguggauuauaugguacagaaaucuggcaagacagggacuauuaccuaccaacgcggaauccucuuaccccagaaaguguggugcgcguccgguagaucaaaggucaucaaaggcagccugccucuuauuggggaggcagacuguuugcaugaaaaguauggaggccugaauaagaguaaaccauacuacacaggugagcacgccaaggcuauagggaacugccccaucugggugaaaacuccgcuaaagcucgccaauggcaccaaauauaggccucccgcaaagcugcuuaaggagcggggauuuuucggcgcuauugccggguuucuggaaggagguugggagggcaugaucgcgggguggcauggauacacaucucacggcgcccacgguguugcaguggcugccgauuugaaauccacccaggaagcuauaaacaagauuacuaaaaaucucaacagccugucggaguuagaagucaagaaucugcagcgccucucuggggccauggacgagcuucauaacgagauccuggaauuggaugagaaaguggacgaccuacgagcagauacgaucuccucacaaauugaacuggccguacuccugaguaaugagggcaucauuaacagcgaagacgagcaccuucuggcuuuggagagaaagcucaagaaaaugcugggaccauccgcgguugaaauaggcaauggguguuucgagacaaagcauaaaugcaaccagaccugcuuagauaggaucgcagccggaacuuuugacgcuggugaguucucucugccuaccuuugauagccuaaauauuacagccgcaucacucaacgacgauggccuggacaaucacaccauccuuuuguauuacaguacugccgcuuccagccuggccgugacacucaugaucgcaauuuucgucguguauauggucucucgggauaacgugucauguaguauaugccuguga

SEQ ID NO: 149124 - RNA, 1758 nt, Artificial Sequence
  derived and/or modified sequence opt3 from hemagglutinin__InfluenzaB__AGX17105
augaaggccaucauugugcugcucauggucguuaccagcaacgcugacagaauaugcacaggcaucacuuccucuaauucaccccacgugguaaaaacggcaacccagggggaaauuaacgugacaggagucaucccucuuacuaccacaccaaccaagagucauuucgccaaucugaaagguacuaagacaaggggcaaauuguguccgaagugcuuaaacuguaccgaucuggacguggcgcuagggcggcccaagugcacgggaaauauuccuagcgcuaaaguuuccauccuccacgaagugcgcccagucacuucuggcuguuuucccauaaugcaugaucgaaccaagauccgucaacugccuaaccuucugagagguuacgagcacauuagguugucgacacauaaugugaucaacgccgaaaaagcaccagggggacccuauaagauuggcacuucaggcagcugcccuaauguaaccaacgggaauggauucuuugccacaauggcuugggcaguuccgaaaaacgacaauaacaagaccgccacgaauagucucacuaucgaggugccacacauauguacagaaggugaggaucagauuaccgucuggggcuuccacuccgacaacgagauccagauggcuaagcuguacggggauucuaaaccccagaaguuuacuagcuccgccaacggagugacaacccauuauauuucacaaaucggcgguuucccuaaucagacggaagacgggggacugccacagaguggccggaucguggucgauuacaugguucagaaaagcggcaagaccgggacaauuacuuaucaacgcggaauacucuuaccccagaaaguguggugcgcgucugguagauccaagguaaucaaaggcucacugccucuuauuggggaggcagacuguuugcacgaaaaguacggaggccugaacaagagcaaaccauauuacaccggugagcaugccaaggcuaucgggaauugccccauaugggugaaaacaccgcuaaagcucgccaacggcacuaaauacaggccucccgcaaagcugcuuaaggagcggggauuuuucggcgcuauugccggguuucuggaaggagguugggagggcaugaucgcgggguggcacggauauaccagucacggcgcccauggugucgcaguggcugccgauuugaaaucuacacaggaagcuaucaauaagauuaccaaaaaccucaauucccugagcgaguuagaaguuaagaaccugcagcgccucucgggggccauggacgagcuucacaaugagauccuggaauuggaugagaaaguggacgaccuacgagcagauacuauuucuucccaaauagaacuggccguccuccugucaaacgagggcaucauuaauagugaagacgagcaucuucuggcuuuggagagaaagcucaagaaaaugcugggaccaagcgcgaucgaaaucggcaacggguguuucgagacgaagcacaaaugcaaucagacaugcuuagauaggauugcagccggaaccuuugacgcuggugaguucucccugccuacuuuugauucucuaaacauaaccgccgcaagccucaaugacgauggccuggacaaccauacaauccuuuuguacuauucaaccgccgcuaguucccuggccgugacucucaugauugcaaucuucguaguuuacauggugagccgggauaacgucucuuguucaauuugccuguga

SEQ ID NO: 149125 - RNA, 1758 nt, Artificial Sequence; identical to SEQ ID NO: 149106
  derived and/or modified sequence opt3 from hemagglutinin__InfluenzaB__AGX17116

SEQ ID NO: 149126 - RNA, 1758 nt, Artificial Sequence
  derived and/or modified sequence opt3 from hemagglutinin__InfluenzaB__AGX17127
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccgaaagucauuucgccaaucugaaggguacuaaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccguguggggcuuccacuccgacaacgaaaaccagauggcuaagcuguauggggauucuaagccccagaaauuuacuagcuccgccaauggagugacaacccacuacgucucacaaauuggcgguuucccuaaccagacggaggacgggggacugccacagaguggccggaucguuguggauuauaugguacaaaagagcggcaauaccgggacaauuacuuaccagcgcggaauccucuuaccccagaaaguguggugcgcgucugguagauccaaggucaucaaaggcucacugccucuuauuggggaagcagacuguuugcaugagaaguauggaggccugaacaaaagcaagccauacuacaccggugagcacgccaaggcuauagggaauugccccaucugggugaaaacaccgcuaaagcucgccaacggcacuaaauauaggccucccgcaaagcugcuuaaagaacggggauuuuucggcgcuauugccggguuucuggagggagguugggaaggcaugaucgcgggguggcauggauacaccagucacggcgcccacgguguugcaguggcugccgauuugaagucuacacaggaggcuauaaauaagauuaccaaaaaccucaauucccugagcgaauuagaggucaagaaccugcagcgccucucgggggccauggacgagcuucauaaugaaauccuggaguuggaugaaaaaguggacgaccuacgagcagauacuaucucuucccaaauugagcuggccguacuccugucaaacgaaggcaucauuaauagugaggacgagcaccuucuggcuuuggaaagaaagcucaaaaagaugcugggaccaagcgcgguugagauaggcaacggguguuucgaaacgaagcauaaaugcaaucagacaugcuuagauaggaucgcagccggaaccuuugacgcuggugaguucucccugccuacuuuugauucucuaaacauuaccgccgcaagccucaacgacgauggccuggacaaucacacaauccuuuuguauuacucaaccgccgcuaguucccuggccgugacucucaugaucgcaauuuucgucguguauauggucagccgggauaacgugucuuguucaauaugccuguga

SEQ ID NO: 149127 - RNA, 1758 nt, Artificial Sequence; identical to SEQ ID NO: 149115
  derived and/or modified sequence opt3 from hemagglutinin__InfluenzaB__AGX17138

SEQ ID NO: 149128 - RNA, 1758 nt, Artificial Sequence; identical to SEQ ID NO: 149115
  derived and/or modified sequence opt3 from hemagglutinin__InfluenzaB__AGX17149

SEQ ID NO: 149129 - RNA, 1758 nt, Artificial Sequence
  derived and/or modified sequence opt3 from hemagglutinin__InfluenzaB__AGX17160
augaaggccaucauugugcugcucauggucguuaccagcaacgcugacagaauaugcacaggcaucacuuccucuaauucaccccacgugguaaaaacggcaacccagggggaagugaacgucacaggaaugauuccucuuacuaccacaccaaccaagagucauuucgccaaucugaaagguacuaagacaaggggcaaauuguguccgaagugcuuaaacuguaccgaucuggacguggcgcuagggcggcccaagugcacgggaaauaucccuagcgcuaaaguuuccauucuccacgaagugcgcccagucacuucuggcuguuuucccaucaugcaugaucgaaccaagauacgucaacugccuaaccuucugagagguuacgagcacaucagguugucgacacauaaugugauuaacgccgaaaaagcaccagggggacccuauaagaucggcacuucaggcagcugcccuaauguaaccaacgggaauggauucuuugccacaauggcuugggcaguuccgaaaaacgacaauaacaagaccgccacgaauagucucacuauugaggugccauacaucuguacagaaggugaggaucagauaaccgucuggggcuuccacuccgacaacgagacucagauggcuaagcuguauggggauucuaaaccccagaaguuuacaagcuccgccaacggagugaccacgcacuacgugucacaaauuggcgguuucccuaaucagaccgaagacgggggacugccacagaguggccggaucgucguugauuauauggugcagaaaagcggcaagacagggacuauuaccuaccaacgcggaauccucuuaccccagaaaguauggugcgcgucugguagauccaaggugaucaaaggcucacugccucuuauuggggaggcagacuguuugcaugaaaaguauggaggccugaacaagagcaaaccauacuacacaggugagcacgccaaggcuauagggaauugccccaucugggucaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguggcaguugcugccgauuugaaaucuacccaggaagcuauaaauaagauuacuaaaaaccucaauucccugagcgaguuagaagugaagaaccugcagcgccucucgggggccauggacgagcuucauaaugagauccuggaauuggaugagaaagucgacgaccuacgagcagauacgaucucuucccaaauugaacuggccgugcuccugucaaacgagggcaucauuaauagugaagacgagcaccuucuggcuuuggagagaaagcucaagaaaaugcugggaccaagcgcgguagaaauaggcaacggguguuucgagacaaagcauaaaugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccguuacacucaugaucgcaauuuucguggucuauauggugagccgggauaacgucucuuguucaauaugccuguga

SEQ ID NO: 149130 - RNA, 1758 nt, Artificial Sequence
  derived and/or modified sequence opt3 from hemagglutinin__InfluenzaB__AGX17171
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccgaaagucauuucgccaaucugaaggguacuaaaacaaggggcaaguuguguccgaaaugcuuaaacuguaccgaucuggacguugcgcuagggcggcccaagugcacgggaaauaucccuagcgcuaagguguccauucuccacgagguccgcccagugacuucuggcuguuuucccaucaugcauaaccgaaccaaaauacgucaacugccuaaucuucugagagguuacgaacacaucagguugucgacacauaacguaauuaaugccgagaaggcaccagggggacccuauaaaaucggcacuucaggcagcugcccuaacguuaccaaugggaacggauucuuugccacaauggcuugggcagugccaaagaaugauaacaauaaaaccgccacgaacagucucacuauugaagucccguacaucuguacagagggugaggaccagauaaccguguggggcuuccacuccgauaacgaagcucagauggccaagcuguauggggacucuaagccccagaaauuuacuagcuccgcgaauggagugacaacccacuacgucucacaaauuggcgguuucccuaaccagacggaggaugggggacugccacagaguggccggaucguuguggacuauaugguacaaaagagcggcaauaccgggacaauuacuuaccagcgcggaauccucuuaccccagaaaguguggugcgcaucugguagauccaaggucaucaaaggcucacugccucuuauuggggaagccgauuguuugcaugagaaguauggaggccugaacaaaagcaagccauacuacaccggugagcacgcuaaggccauagggaauugccccaucugggugaaaacaccgcuaaagcucgcaaacggcacuaaauauaggccucccgcuaagcugcuuaaagaacggggauuuuucggcgccauugcgggguuucuggagggagguugggaaggcaugaucgccggguggcauggauacaccagucacggcgcacacgguguugcuguggccgcugacuugaagucuacacaggaggccauaaauaagauuaccaaaaaccucaauucccugagcgaauuagaggucaagaaccugcagcgccucucgggggcaauggaugagcuucauaaugaaauccuggaguuggacgaaaaaguggaugaccuacgagccgacacuaucucuucccaaauugagcuggcuguacuccugucaaacgaaggcaucauuaauagugaggaugagcaccuucuggcguuggaaagaaagcucaaaaagaugcugggaccaagcgcaguugagauaggcaacggguguuucgaaacgaagcauaaaugcaaucagacaugcuuagacaggaucgccgcuggaaccuuugaugccggugaguucucccugccuacuuuugacucucuaaacauuaccgcagccagccucaacgaugacggccuggauaaucacacaauccuuuuguauuacucaaccgcugccaguucccuggcagugacucucaugaucgcgauuuucgucguguauauggucagccgggacaacgugucuuguucaauaugccuguga

SEQ ID NO: 149131 - RNA, 1758 nt, Artificial Sequence; identical to SEQ ID NO: 148995
  derived and/or modified sequence opt3 from hemagglutinin__InfluenzaB__AGX17182

SEQ ID NO: 149132 - RNA, 1758 nt, Artificial Sequence; identical to SEQ ID NO: 148995
  derived and/or modified sequence opt3 from hemagglutinin__InfluenzaB__AGX17193

SEQ ID NO: 149133 - RNA, 1758 nt, Artificial Sequence; identical to SEQ ID NO: 148995
  derived and/or modified sequence opt3 from hemagglutinin__InfluenzaB__AGX17204

SEQ ID NO: 149134 - RNA, 1758 nt, Artificial Sequence
  derived and/or modified sequence opt3 from hemagglutinin__InfluenzaB__AGX17215
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgaggcucagauggccaagcuguauggggauucuaaaccccagaaguuuacuagcuccgcgaacggagugacaacccacuacgucucacaaauuggcgguuucccuaaucagacggaagacgggggacugccacagaguggccggaucguuguggauuauaugguacagaaaagcggcaagaccgggacaauuacuuaccaacgcggaauccucuuaccccagaaaguguggugcgcaucugguagauccaaggucaucaaaggcucacugccucuuauuggggaggccgacuguuugcaugaaaaguauggaggccugaacaagagcaaaccauacuacaccggugagcacgcuaaggccauagggaauugccccaucugggugaaaacaccgcuaaagcucgcaaacggcacuaaauauaggccucccgcuaagcugcuuaaggagcggggauuuuucggcgccauugcgggguuucuggaaggagguugggagggcaugaucgccggguggcauggauacaccagucacggcgcacacgguguugcuguggccgcugauuugaaaucuacacaggaagccauaaauaagauuaccaaaaaccucaauucccugagcgaguuagaagucaagaaccugcagcgccucucgggggcaauggacgagcuucauaaugagauccuggaauuggaugagaaaguggacgaccuacgagccgauacuaucucuucccaaauugaacuggcuguacuccugucaaacgagggcaucauuaauagugaagacgagcaccuucuggcguuggagagaaagcucaagaaaaugcugggaccaagcgcaauagaaaucggcaacggguguuucgagacgaagcauaaaugcaaucagacaugcuuagauaggauugccgcuggaaccuuugacgccggugaguucucccugccuacuuuugauucucuaaacaucaccgcagccagccucaaugacgauggccuggacaaccacacaauccuuuuguauuacucaaccgcugccaguucccuggcaguuacucucaugauugcgauauucguggucuauauggugagccgggauaacgucucuuguucaaucugccuguga

SEQ ID NO: 149135 - RNA, 1758 nt, Artificial Sequence; identical to SEQ ID NO: 148995
  derived and/or modified sequence opt3 from hemagglutinin__InfluenzaB__AGX17226

SEQ ID NO: 149136 - RNA, 1758 nt, Artificial Sequence
  derived and/or modified sequence opt3 from hemagglutinin__InfluenzaB__AGX17237
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauauuaccaacgggaauggauucuuugccacaauggcuugggcaguuccgaaaaacgacaauaacaagaccgccacgaauagucucacuaucgaggugccauacauauguacagaaggugaggaucagauuaccgucuggggcuuccacuccgacaacgagauccagauggcuaagcuguauggggauucuaaaccccagaaguuuacuagcuccgccaacggagugacaacccacuacgugucacaaauuggcgguuucccuaaucagacggaagacgggggacugccacagaguggccggaucgucguugauuauauggugcagaaaagcggcaagaccgggacaaucacuuaccaacgcgguauucucuuaccccagaaaguauggugcgcgucuggaagauccaaggugauaaaaggcucacugccucuuaucggggaggcagacuguuugcaugaaaaguauggaggccugaacaagagcaaaccauacuacaccggugagcacgccaaggcuauugggaauugccccaucugggucaaaacaccgcuaaagcucgccaacggcacuaaauauaggccucccgcaaagcugcuuaaggagcggggauuuuucggcgcuauagccggguuucuggaaggagguugggagggcaugauugcgggguggcauggauacaccagucacggcgcccacgguguggcaguugcugccgauuugaaaucuacacaggaagcuaucaauaagaucaccaaaaaccucaauucccugagcgaguuagaagugaagaaccugcagcgccucucgggggccauggacgagcuucauaaugagauucuggaauuggaugagaaagucgacgaccuacgagcagauacuaucucuucccaaauugaacuggccgugcuccugucaaacgagggcauaaucaauagugaagacgagcaccuucuggcuuuggagagaaagcucaagaaaaugcugggaccaagcgcgguagaaauuggcaacggguguuucgagacgaagcauaaaugcaaucagacaugcuuagauaggaucgcagccggaaccuuugacgcuggugaguucucccugccuacuuuugauucucuaaacaucaccgccgcaagccucaaugacgauggccuggacaaccacacaauucuuuuguauuacucaaccgccgcuaguucccuggccguuacucucaugauagcaaucuucguggucuauauggugagccgggauaacgucucuuguucaauuugccuguga

SEQ ID NO: 149137 - RNA, 1758 nt, Artificial Sequence
  derived and/or modified sequence opt3 from hemagglutinin__InfluenzaB__AGX17248
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcacaucugguagauccaaggucaucaaaggcucacugccucuuauuggggaggcggacuguuugcaugaaaaguauggaggccugaacaagagcaaaccauacuacacuggugagcacgcaaaggccauagggaauugccccaucugggugaaaaccccgcuaaagcucgcuaacggcacaaaauauaggccucccgccaagcugcuuaaggagcggggauuuuucggcgcaauugcuggguuucuggaaggagguugggagggcaugaucgccggguggcauggauacaccagucacggcgcgcacgguguugccguggcagcugauuugaaaucuacucaggaagccauaaauaagauuacgaaaaaccucaauucccugagcgaguuagaagucaagaaccugcagcgccucucgggggcuauggacgagcuucauaaugagauccuggaauuggaugagaaaguggacgaccuacgagccgauacaaucucuucccaaauugaacuggcaguacuccugucaaacgagggcaucauuaauagugaagacgagcaccuucuggccuuggagagaaagcucaagaaaaugcugggaccaagcgcuguugaaauaggcaacggguguuucgagaccaagcauaaaugcaaucagacuugcuuagauaggaucgcggcaggaaccuuugacgccggugaguucucccugccuacauuugauucucuaaacauuaccgcugccagccucaaugacgauggccuggacaaccacacuauccuuuuguauuacucaacagcagccaguucccuggcugugacgcucaugaucgccauuuucgucguguauauggucagccgggauaacgugucuuguucaauaugccuguga

SEQ ID NO: 149138 - RNA, 1758 nt, Artificial Sequence; identical to SEQ ID NO: 149079
  derived and/or modified sequence opt3 from hemagglutinin__InfluenzaB__AGX17270

SEQ ID NO: 149139 - RNA, 1758 nt, Artificial Sequence; identical to SEQ ID NO: 148995
  derived and/or modified sequence opt3 from hemagglutinin__InfluenzaB__AGX17281

SEQ ID NO: 149140 - RNA, 1758 nt, Artificial Sequence; identical to SEQ ID NO: 148995
  derived and/or modified sequence opt3 from hemagglutinin__InfluenzaB__AGX17292

SEQ ID NO: 149141 - RNA, 1758 nt, Artificial Sequence; identical to SEQ ID NO: 148995
  derived and/or modified sequence opt3 from hemagglutinin__InfluenzaB__AGX17303

SEQ ID NO: 149142 - RNA, 1758 nt, Artificial Sequence; identical to SEQ ID NO: 149121
  derived and/or modified sequence opt3 from hemagglutinin__InfluenzaB__AGX17314

SEQ ID NO: 149143 - RNA, 1758 nt, Artificial Sequence; identical to SEQ ID NO: 148995
  derived and/or modified sequence opt3 from hemagglutinin__InfluenzaB__AGX17325

SEQ ID NO: 149144 - RNA, 1758 nt, Artificial Sequence; identical to SEQ ID NO: 149106
  derived and/or modified sequence opt3 from hemagglutinin__InfluenzaB__AGX17336

SEQ ID NO: 149145 - RNA, 1758 nt, Artificial Sequence; identical to SEQ ID NO: 148995
  derived and/or modified sequence opt3 from hemagglutinin__InfluenzaB__AGX17347

SEQ ID NO: 149146 - RNA, 1758 nt, Artificial Sequence; identical to SEQ ID NO: 148995
  derived and/or modified sequence opt3 from hemagglutinin__InfluenzaB__AGX17358

SEQ ID NO: 149147 - RNA, 1758 nt, Artificial Sequence
  derived and/or modified sequence opt3 from hemagglutinin__InfluenzaB__AGX17369
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguugcggauuauauggugcagaaaagcggcaagacagggacuauuaccuaccaacgcggaauccucuuaccccagaaaguauggugcgcaucugguagauccaaggugaucaaaggcucacugccucuuauuggggaggccgacuguuugcaugaaaaguauggaggccugaacaagagcaaaccauacuacacaggugagcacgcuaaggccauagggaauugccccaucugggucaaaacuccgcuaaagcucgcaaacggcaccaaauauaggccucccgcuaagcugcuuaaggagcggggauuuuucggcgccauugcgggguuucuggaaggagguugggagggcaugaucgccggguggcauggauacacaagucacggcgcacacgguguggcuguugccgcugauuugaaaucuacccaggaagccauaaauaagauuacuaaaaaccucaauucccugagcgaguuagaagugaagaaccugcagcgccucucgggggcaauggacgagcuucauaaugagauccuggaauuggaugagaaagucgacgaccuacgagccgauacgaucucuucccaaauugaacuggcugugcuccugucaaacgagggcaucauuaauagugaagacgagcaccuucuggcguuggagagaaagcucaagaaaaugcugggaccaagcgcaguagaaauaggcaacggguguuucgagacaaagcauaaaugcaaucagaccugcuuagauaggaucgccgcuggaacuuuugacgccggugaguucucccugccuaccuuugauucucuaaacauuacagcagccagccucaaugacgauggccuggacaaccacaccauccuuuuguauuacucaacugcugccaguucccuggcaguuacacucaugaucgcgauuuucguggucuauauggugagccgggauaacgucucuuguucaauaugccuguga

SEQ ID NO: 149148 - RNA, 1758 nt, Artificial Sequence; identical to SEQ ID NO: 149121
  derived and/or modified sequence opt3 from hemagglutinin__InfluenzaB__AGX17380

SEQ ID NO: 149149 - RNA, 1758 nt, Artificial Sequence; identical to SEQ ID NO: 148995
  derived and/or modified sequence opt3 from hemagglutinin__InfluenzaB__AGX17391

SEQ ID NO: 149150 - RNA, 1758 nt, Artificial Sequence
  derived and/or modified sequence opt3 from hemagglutinin__InfluenzaB__AGX17400
augaaggccaucauugugcugcucauggucguuaccagcaacgcugacagaauaugcacaggcaucacuuccucuaauucaccccacauggugaaaacggcaacccagggggaaguaaacgugacaggagucauuccucuuacuaccacaccaaccaagagucauuucgccaaucugaaagguacuaagacaaggggcaaauuguguccgaagugcuuaaacuguaccgaucuggacguggcgcuagggcggcccaagugcacgggaaauaucccuagcgcuaaaguuuccauucuccacgaagugcgcccagucacuucuggcuguuuucccaucaugcaugaucgaaccaagauacgucaacugccuaaccuucugagagguuacgagcacaucagguugucgacacauaaugugauuaacgccgaaaaagcaccagggggacccuauaagaucggcacuucaggcagcugcccuaauguaaccaacgggaauggauucuuugccacaauggcuugggcaguuccgaaaaacgacaauaacaagaccgccacgaauagucucacuauugaggugccauacaucuguacagaaggugaggaucagauaaccgucuggggcuuccacuccgacaacgagacucagauggcuaagcuguauggggauucuaaaccccagaaguuuacaagcuccgccaacggagugaccacgcacuacgugucacaaauuggcgguuucccuaaucagaccgaagacgggggacugccacagaguggccggaucgucguugauuauauggugcagaaaagcggcaagacagggacuauuaccuaccaacgcggaauccucuuaccccagaaaguauggugcgcgucugguagauccaaggugaucaaaggcucacugccucuuauuggggaggcagacuguuugcaugaaaaguauggaggccugaacaagagcaaaccauacuacacaggugagcacgccaaggcuauagggaauugccccaucugggucaaaacuccgcuaaagcucgccaacggcaccaaauauaggccucccgcaaagcugcuuaaggagcggggauuuuucggcgcuauugccggguuucuggaaggagguugggagggcaugaucgcgggguggcauggauacacaagucacggcgcccacgguguggcaguugcugccgauuugaaaucuacccaggaagcuauaaauaagauuacuaaaaaccucaauucccugagcgaguuagaagugaagaaccugcagcgccucucgggggccauggacgagcuucauaaugagauccuggaauuggaugagaaagucgacgaccuacgagcagauacgaucucuucccaaauugaacuggccgugcuccugucaaacgagggcaucauuaauagugaagacgagcaccuucuggcuuuggagagaaagcucaagaaaaugcugggaccaagcgcgguagaaauaggcaacggguguuucgagacaaagcauaaaugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccguuacacucaugaucgcaauuuucguggucuauauggugagccgggauaacgucucuuguucaauaugccuguga

SEQ ID NO: 149151 - RNA, 1758 nt, Artificial Sequence; identical to SEQ ID NO: 148995
  derived and/or modified sequence opt3 from hemagglutinin__InfluenzaB__AGX17411

SEQ ID NO: 149152 - RNA, 1758 nt, Artificial Sequence; identical to SEQ ID NO: 148995
  derived and/or modified sequence opt3 from hemagglutinin__InfluenzaB__AGX17422

SEQ ID NO: 149153 - RNA, 1758 nt, Artificial Sequence; identical to SEQ ID NO: 149078
  derived and/or modified sequence opt3 from hemagglutinin__InfluenzaB__AGX17433

SEQ ID NO: 149154 - RNA, 1758 nt, Artificial Sequence; identical to SEQ ID NO: 148995
  derived and/or modified sequence opt3 from hemagglutinin__InfluenzaB__AGX17444

SEQ ID NO: 149155 - RNA, 1758 nt, Artificial Sequence; identical to SEQ ID NO: 149078
  derived and/or modified sequence opt3 from hemagglutinin__InfluenzaB__AGX17455

SEQ ID NO: 149156 - RNA, 1758 nt, Artificial Sequence; identical to SEQ ID NO: 149121
  derived and/or modified sequence opt3 from hemagglutinin__InfluenzaB__AGX17466

SEQ ID NO: 149157 - RNA, 1758 nt, Artificial Sequence; identical to SEQ ID NO: 148995
  derived and/or modified sequence opt3 from hemagglutinin__InfluenzaB__AGX17477

SEQ ID NO: 149158 - RNA, 1758 nt, Artificial Sequence; identical to SEQ ID NO: 149080
  derived and/or modified sequence opt3 from hemagglutinin__InfluenzaB__AGX17488

SEQ ID NO: 149159 - RNA, 1758 nt, Artificial Sequence; identical to SEQ ID NO: 148995
  derived and/or modified sequence opt3 from hemagglutinin__InfluenzaB__AGX17499

SEQ ID NO: 149160 - RNA, 1758 nt, Artificial Sequence; identical to SEQ ID NO: 149121
  derived and/or modified sequence opt3 from hemagglutinin__InfluenzaB__AGX17510

SEQ ID NO: 149161 - RNA, 1758 nt, Artificial Sequence; identical to SEQ ID NO: 149121
  derived and/or modified sequence opt3 from hemagglutinin__InfluenzaB__AGX17521

SEQ ID NO: 149162 - RNA, 1758 nt, Artificial Sequence; identical to SEQ ID NO: 149123
  derived and/or modified sequence opt3 from hemagglutinin__InfluenzaB__AGX17532

SEQ ID NO: 149163 - RNA, 1758 nt, Artificial Sequence
  derived and/or modified sequence opt3 from hemagglutinin__InfluenzaB__AGX17543
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccagccugaaagguacuaagacaaggggcaaauuguguccgaagugcuuaaauuguaccgaucuggacguugcgcuagggcggcccaagugcacgggaaacaucccuuccgcuaaagugucuauucuccacgaaguccgcccagugacuucgggcuguuuucccaucaugcaugaucgaaccaagauacgucaacugccuaaucuucugagagguuacgagcacaucagguugucaacacauaacguaauuaaugccgaaaaagcaccagggggacccuauaagaucggcacuagcggcaguugcccuaacguuaccaaugggaacggauucuuugccacaauggcuugggcagugccgaaaaaugacaacaauaagaccgccacgaacucccucacuauugaggucccauacaucuguacagaaggugaggaucagauaaccguguggggcuuccacucugacaaugagacucagauggcuaagcuguauggggauagcaaaccccagaaguuuacauccucagccaacggagugaccacgcacuacgucagucaaauuggcgguuucccuaaccagaccgaagacgggggacugccacagagcggccggaucguuguggauuauaugguacagaaaucuggcaagacagggacuauuaccuaccaacgcggaauccucuuaccccagaaaguguggugcgcguccgguagaucaaaggucaucaaaggcagccugccucuuauuggggaggcagacuguuugcaugaaaaguauggaggccugaauaagaguaaaccauacuacacaggugagcacgccaaggcuauagggaacugccccaucugggugaaaacuccgcuaaagcucgccaauggcaccaaauauaggccucccgcaaagcugcuuaaggagcggggauuuuucggcgcuauugccggguuucuggaaggagguugggagggcaugaucgcgggguggcauggauacacaucucacggcgcccacgguguugcaguggcugccgauuugaaauccacccaggaagcuauaaacaagauuacuaaaaaucucaacagccugucggaguuagaagucaagaaucugcagcgccucucuggggccaugaacgagcuucauaaugagauccuggaauuggacgagaaaguggaugaccuacgagcagacacgaucuccucacaaauugaacuggccguacuccugaguaacgagggcaucauuaauagcgaagaugagcaccuucuggcuuuggagagaaagcucaagaaaaugcugggaccauccgcgguugaaauaggcaacggguguuucgagacaaagcauaaaugcaaucagaccugcuuagacaggaucgcagccggaacuuuugaugcuggugaguucucucugccuaccuuugacagccuaaacauuacagccgcaucacucaaugaugacggccuggauaaccacaccauccuuuuguauuacaguacugccgcuuccagccuggccgugacacucaugaucgcaauuuucgucguguauauggucucucgggacaacgugucauguaguauaugccuguga

SEQ ID NO: 149164 - RNA, 1758 nt, Artificial Sequence
  derived and/or modified sequence opt3 from hemagglutinin__InfluenzaB__AGX17554
augaaggccaucauugugcugcuccuugucguuaccagcaacgcugacagaauaugcacaggcaucacuuccucuaauucaccccacgugguaaaaacggcaacccagggggaagugaacgucacaggagugauuccucugacuaccacaccaaccaagagucauuucgccaauuugaaagguacuaagacaaggggcaaauuauguccgaagugccugaacuguaccgaucuagacguugcgcucgggcggcccaagugcacgggaaauaucccuagcgcuaaaguguccauucugcacgaaguccgcccagugacuucuggcuguuuucccaucaugcaugaucgaaccaagauacgucaacuuccuaaccuguugagagguuacgagcacaucaggcucucgacacauaauguaauuaacgccgaaaaagcaccagggggacccuauaagaucggcacuucaggcagcugcccuaauguuaccaacgggaauggauucuuugccacaauggcuugggcagugccaaagaacgacaauaacaagaccgccacgaauagucugacuauugaggucccguacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacucccacagaguggccggaucguuguggauuauaugguacagaaaagcggcaagacagggacuauuaccuaccaacgcggaaucuuacugccccagaaaguguggugcgcgucugguagauccaaggucaucaaaggcucacuuccuuugauuggggaggcagacugucugcaugaaaaguauggaggccuaaacaagagcaaaccauacuacacaggugagcacgccaaggcuauagggaauugccccaucugggugaaaacuccgcucaagcuggccaacggcaccaaauauaggccucccgcaaaacuucugaaggagcggggauuuuucggcgcuauugccggguuuuuggaaggagguugggagggcaugaucgcgggguggcauggauacacaagucacggcgcccacgguguugcaguggcugccgaucucaaaucuacccaggaagcuauaaauaagauuacuaaaaacuuaaauucccugagcgagcuggaagucaagaaccuccagcgccuuucgggggccauggacgagcugcauaaugagaucuuggaacuagaugagaaaguggacgaccugcgagcagauacgaucucuucccaaauugaacucgccguacugcuuucaaacgagggcaucauuaauagugaagacgagcaccuguuggcucucgagagaaagcugaagaaaauguuaggaccaagcgcgguugaaauaggcaacggguguuucgagacaaagcauaaaugcaaucagaccugccuggauaggaucgcagccggaacuuuugacgcuggugaguucucccuaccuaccuuugauucucucaacauuacagccgcaagccugaaugacgauggccuugacaaccacaccaucuugcuguauuacucaacugccgcuaguucccucgccgugacacugaugaucgcaauuuucgucguguauauggucagccgggauaacgugucuuguucaauaugccuuuga

SEQ ID NO: 149165 - RNA, 1755 nt, Artificial Sequence; identical to SEQ ID NO: 149039
  derived and/or modified sequence opt3 from hemagglutinin__InfluenzaB__AGX17565

SEQ ID NO: 149166 - RNA, 1758 nt, Artificial Sequence
  derived and/or modified sequence opt3 from hemagglutinin__InfluenzaB__AGX17576
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauggcaauuuucguggucuauauggugagccgggauaacgucucuuguucaauaugccuguga

SEQ ID NO: 149167 - RNA, 1758 nt, Artificial Sequence; identical to SEQ ID NO: 148530
  derived and/or modified sequence opt3 from hemagglutinin__InfluenzaB__AGX17598

SEQ ID NO: 149168 - RNA, 1758 nt, Artificial Sequence
  derived and/or modified sequence opt3 from hemagglutinin__InfluenzaB__AGX17609
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaauaacaagaccgccacgaauagucucacuauugaagucccauacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcuauaaauaagauuacuaaaaaccucaauucccugagcgaauuagaggucaagaaccugcagcgacucucgggggccauggacgagcuucauaaugaaauccuggaguuggaugaaaaaguggacgaccuaagagcagauacgaucucuucccaaauugagcuggccguacuccugucaaacgaaggcaucauuaauagugaggacgagcaccuucuggcuuuggaaaggaagcucaaaaagaugcugggaccaagcgcgguugagauaggcaacggguguuucgaaacaaagcauaaaugcaaucagaccugcuuagaucggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgugauaacgugucuuguucaauaugccuguga

SEQ ID NO: 149169 - RNA, 1758 nt, Artificial Sequence; identical to SEQ ID NO: 148997
  derived and/or modified sequence opt3 from hemagglutinin__InfluenzaB__AGX17620

SEQ ID NO: 149170 - RNA, 1758 nt, Artificial Sequence; identical to SEQ ID NO: 148530
  derived and/or modified sequence opt3 from hemagglutinin__InfluenzaB__AGX17631

SEQ ID NO: 149171 - RNA, 1758 nt, Artificial Sequence; identical to SEQ ID NO: 148654
  derived and/or modified sequence opt3 from hemagglutinin__InfluenzaB__AGX17642

SEQ ID NO: 149172 - RNA, 1758 nt, Artificial Sequence; identical to SEQ ID NO: 148997
  derived and/or modified sequence opt3 from hemagglutinin__InfluenzaB__AGX17653

SEQ ID NO: 149173 - RNA, 1758 nt, Artificial Sequence; identical to SEQ ID NO: 148530
  derived and/or modified sequence opt3 from hemagglutinin__InfluenzaB__AGX17664

SEQ ID NO: 149174 - RNA, 1758 nt, Artificial Sequence; identical to SEQ ID NO: 148654
  derived and/or modified sequence opt3 from hemagglutinin__InfluenzaB__AGX17675

SEQ ID NO: 149175 - RNA, 1758 nt, Artificial Sequence; identical to SEQ ID NO: 148997
  derived and/or modified sequence opt3 from hemagglutinin__InfluenzaB__AGX17686

SEQ ID NO: 149176 - RNA, 1758 nt, Artificial Sequence
  derived and/or modified sequence opt3 from hemagglutinin__InfluenzaB__AGX17697
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggagagaucccuagcgcucgcguguccauucuccacgaaguccgaccagugacuucuggcuguuuucccaucaugcaugaucguaccaagauaagacaacugccuaaucuucugagggguuacgagcacauccgguugucgacacauaacgccauuaaugcagaaaacgccccagggggacccuauaaaaucggcacuucaggcagcugcccuaauguaaccaacgggaauggauucuuugcuacaauggcaugggccguuccaaagaacgacaauaacaaaaccgcuacgaauagucucacuauugaggugccguacaucuguacagagggugaagaucagauaaccgucuggggcuuccacuccgacaacgagacucagauggccaagcuguauggggauucuaaaccccagaaguuuacaagcuccgcgaacggagugaccacgcacuacgugucacaaauuggcgguuucccuaaucagaccgaagacgggggacugccacagaguggccgcaucgucguugauuauauggugcaaaagagcggcaaaacagggacuauuaccuaccagagaggaauccucuuaccccagaagguauggugcgcaucugguagguccaaagugaucaagggcucacugccucuuauuggggaggccgacuguuugcaugagaaauauggaggccugaacaagagcaaaccauacuacacaggugaacacgcuaaggccauagggaauugccccaucugggucaagacuccgcuaaaacucgcaaacggcaccaaguaucggccucccgcuaaacugcuuaaggagcgcggauuuuucggcgccauugcgggguuucuggaaggagguugggagggcaugaucgccggguggcauggauacacaagucacggcgcacacgguguggcuguugccgcugauuugaaaucuacccaggaagccauaaauaagauuacuaagaaccucaauucccugagcgaguuagaggugaaaaaccugcagcgacucucgggggcaauggacgaacuucauaaugagauccuggaauuggaugagaaggucgacgaccuaagagccgauacgaucucuucccaaauugaacuggcugugcuccugucaaacgagggcaucauuaauagugaggacgaacaccuucuggcguuggagaggaaacucaagaaaaugcugggaccaagcgcaguagaaauaggcaacggguguuucgagacaaagcauaagugcaaucagaccugcuuagaucggaucgccgcuggaacuuuugacgccggugaguucucccugccuaccuuugauucucuaaacauuacagcagccagccucaaugacgauggccuggacaaccacaccauccuuuuguauuacucaacugcugccaguucccuggcaguuacacucaugaucgcgauuuucguggucuauauggugagccgugauaacgucucuuguucaauaugccuguga

SEQ ID NO: 149177 - RNA, 1758 nt, Artificial Sequence; identical to SEQ ID NO: 148654
  derived and/or modified sequence opt3 from hemagglutinin__InfluenzaB__AGX17708

SEQ ID NO: 149178 - RNA, 1758 nt, Artificial Sequence; identical to SEQ ID NO: 148997
  derived and/or modified sequence opt3 from hemagglutinin__InfluenzaB__AGX17719

SEQ ID NO: 149179 - RNA, 1758 nt, Artificial Sequence; identical to SEQ ID NO: 148654
  derived and/or modified sequence opt3 from hemagglutinin__InfluenzaB__AGX17730

SEQ ID NO: 149180 - RNA, 1758 nt, Artificial Sequence; identical to SEQ ID NO: 148530
  derived and/or modified sequence opt3 from hemagglutinin__InfluenzaB__AGX17741

SEQ ID NO: 149181 - RNA, 1758 nt, Artificial Sequence; identical to SEQ ID NO: 148997
  derived and/or modified sequence opt3 from hemagglutinin__InfluenzaB__AGX17752

SEQ ID NO: 149182 - RNA, 1758 nt, Artificial Sequence; identical to SEQ ID NO: 148997
  derived and/or modified sequence opt3 from hemagglutinin__InfluenzaB__AGX17774

SEQ ID NO: 149183 - RNA, 1758 nt, Artificial Sequence
  derived and/or modified sequence opt3 from hemagglutinin__InfluenzaB__AGX17785
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacguaagguugucgacacauaauguuaucaacgccgagaaggcaccagggggacccuauaaaauuggcacuucaggcagcugcccuaaugugaccaacgggaauggauucuuugccacaauggcuugggcagucccaaagaacgacaauaacaaaaccgccacgaauagucucacuaucgaagugccguacauuuguacagagggugaggaucagaucaccauauggggcuuccacuccgacaacgaaacucagauggcuaagcuguauggggauucuaagccccagaaauuuacaagcuccgccaacggagugaccacgcacuacgucucacaaauuggcgguuucccuaaucagaccgaggacgggggacugccacagaguggccggaucguuguggauuauaugguacaaaagagcggcaaaacagggacuauuaccuaccagcgcggaauccucuuaccccagaagguguggugcgcgucugguagauccaaagucaucaagggcucacugccucuuauuggggaagcagacuguuugcaugagaaauauggaggccugaacaagagcaagccauacuacacaggugagcacgccaaagcuauagggaauugccccaucugggugaagacuccgcuaaaacucgccaacggcaccaaguauaggccucccgcaaaacugcuuaaggaacggggauuuuucggcgcuauugccggguuucuggagggagguugggaaggcaugaucgcgggguggcauggauacacaagucacggcgcccacgguguugcaguggcugccgauuugaagucuacccaggaggcuauaaauaaaauuacuaagaaccucaauucccugagcgaauuagaggucaaaaaccugcagcgccucucgggggccauggacgagcuucauaaugaaauccuggaguuggaugaaaagguggacgaccuacgagcagauacgaucucuucccaaauugagcuggccguacuccugucaaacgaaggcaucauuaauagugaggacgagcaccuucuggcuuuggaaagaaaacucaagaagaugcugggaccaagcgcgguugagauaggcaacggguguuucgaaacaaaacauaagugcaaucagaccugcuuagauaggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgggauaacgugucuuguucaauaugccuguga

SEQ ID NO: 149184 - RNA, 1758 nt, Artificial Sequence; identical to SEQ ID NO: 148997
  derived and/or modified sequence opt3 from hemagglutinin__InfluenzaB__AGX17796

SEQ ID NO: 149185 - RNA, 1758 nt, Artificial Sequence; identical to SEQ ID NO: 148581
  derived and/or modified sequence opt3 from hemagglutinin__InfluenzaB__AGX17807

SEQ ID NO: 149186 - RNA, 1758 nt, Artificial Sequence; identical to SEQ ID NO: 149168
  derived and/or modified sequence opt3 from hemagglutinin__InfluenzaB__AGX17818

SEQ ID NO: 149187 - RNA, 1758 nt, Artificial Sequence
  derived and/or modified sequence opt3 from hemagglutinin__InfluenzaB__AGX17829
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaauaacaagaccgccacgaauagucucacuauugaagucccauacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcugucaauaagauaacuaaaaaccucaauucccugagcgaauuagaggugaagaaccugcagcgacucucgggggccauggacgagcuucauaaugaaauucuggaguuggaugaaaaaguagacgaccuaagagcagauacgaucucuucccaaaucgagcuggccguucuccugucaaacgaaggcauuaucaauagugaggacgagcaccuucuggcuuuggaaaggaagcucaaaaagaugcugggaccaagcgcgguggagauuggcaacggguguuucgaaacaaagcauaaaugcaaucagaccugcuuagaucggauagcagccggaacuuuugacgcuggugaguucucccugccuaccuuugauucucuaaacaucacagccgcaagccucaaugacgauggccuggacaaccacaccauucuuuuguauuacucaacugccgcuaguucccuggccgucacacucaugaucgcaaucuucguggucuauauggugagccgugauaacguuucuuguucaauuugccuguga

SEQ ID NO: 149188 - RNA, 1758 nt, Artificial Sequence; identical to SEQ ID NO: 148654
  derived and/or modified sequence opt3 from hemagglutinin__InfluenzaB__AGX17840

SEQ ID NO: 149189 - RNA, 1758 nt, Artificial Sequence; identical to SEQ ID NO: 148997
  derived and/or modified sequence opt3 from hemagglutinin__InfluenzaB__AGX17851

SEQ ID NO: 149190 - RNA, 1758 nt, Artificial Sequence
  derived and/or modified sequence opt3 from hemagglutinin__InfluenzaB__AGX17862
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcacacugccucuuauaggggaagcagacuguuugcaugagaaauauggaggccugaacaagucaaagccauacuacacuggugagcacgccaaagcuaucgggaauugccccauuugggucaagaccccgcuaaaacucgccaacggcacaaaguauaggccucccgcaaaacugcuuaaggaacggggauuuuucggcgcuaucgccggguuucuggagggagguugggaaggcaugauagcgggguggcauggauacaccagccacggcgcccacgguguggcaguugcugccgauuugaagaguacucaggaggcuauuaauaaaaucacgaagaaccucaauucucuguccgaauuagaggugaaaaaccugcagcgccucagcggggccauggacgagcuucauaaugaaauccuggaguuggaugaaaaggucgacgaccuacgagcagauacaauuucgucucaaaucgagcuggccgugcuccuguccaacgaaggcauuauaaauucagaggacgagcaccuucuggcuuuggaaagaaaacucaagaagaugcugggaccaagugcgguagagaucggcaacggguguuucgaaaccaaacauaagugcaaucagacuugcuuagauaggauugcagccggaaccuuugacgcuggugaguucagccugccuacauuugauucccuaaacaucaccgccgcaucucucaaugacgauggccuggacaaccacacuauccuuuuguauuacagcacagccgcuucaagucuggccguuacgcucaugauugcaauauucguggucuauauggugucccgggauaacgucagcuguucuaucugccuguga

SEQ ID NO: 149191 - RNA, 1758 nt, Artificial Sequence
  derived and/or modified sequence opt3 from hemagglutinin__InfluenzaB__AGX17873
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuagauuguaccgaccuggauguugcgcuagggcggcccaagugcacgggaaacaucccuagcgcucgcguguccauucuccacgagguccgaccagugacuucuggcuguuuucccaucaugcaugaccguaccaagauaagacaacugccuaaucuucugagggguuacgaacacauccgguugucgacacauaacguaauuaaugccgagaacgcaccagggggacccuauaaaaucggcacuucaggcagcugcccuaauguuaccaacgggaauggauucuuugccacaauggcuugggcagugccaaagaacgauaauaacaaaaccgccacgaauagucucacuauugaagucccguacaucuguacagagggugaggaccagauaaccguguggggcuuccacuccgauaacgaaacucagauggcuaagcuguauggggacucuaaaccccagaaguuuacaagcuccgccaacggagugaccacgcacuacgucucacaaauuggcgguuucccuaaucagaccgaggaugggggacugccacagaguggccgcaucguuguggacuauaugguacaaaagagcggcaaaacagggacuauuaccuaccagagaggaauccucuuaccccagaagguguggugcgcgucugguagguccaaagucaucaagggcucacugccucuuauuggggaagcagauuguuugcaugagaaauauggaggccugaacaagagcaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgacuugaaaucuacccaggaggcuauaaauaagauuacuaagaaccucaauucccugagcgaauuagaggucaaaaaccugcagcgacucucgggggccauggaugagcuucauaaugaaauccuggaguuggacgaaaagguggacgaucuaagagcagacacgaucucuucccaaauugagcuggccguacuccugucaaacgaaggcaucauuaauagugaggaugagcaccuucuggcuuuggaaaggaaacucaagaaaaugcugggaccaagcgcgguugagauaggcaacggguguuucgaaacaaagcauaagugcaaucagaccugcuuagaccggaucgcagccggaacuuuugaugcuggugaguucucccugccuaccuuugacucucuaaacauuacagccgcaagccucaaugaugacggccuggauaaccacaccauccuuuuguauuacucaacugccgcuaguucccuggccgugacacucaugaucgcaauuuucgucguguauauggucagccgugacaacgugucuuguucaauaugccuguga

SEQ ID NO: 149192 - RNA, 1758 nt, Artificial Sequence; identical to SEQ ID NO: 148654
  derived and/or modified sequence opt3 from hemagglutinin__InfluenzaB__AGX17884

SEQ ID NO: 149193 - RNA, 1758 nt, Artificial Sequence
  derived and/or modified sequence opt3 from hemagglutinin__InfluenzaB__AGX17895
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaaaucagauggcuaagcuguauggggauucuaaaccccagaaguuuacuagcuccgccaacggagugacaacccacuacgucucacaaauuggcgguuucccuaaucagacggaggacgggggacugccacagaguggccgcaucguuguggauuauaugguacaaaagagcggcaaaaccgggacaauuacuuaccagagaggaauccucuuaccccagaagguguggugcgcgucugguagguccaaagucaucaagggcucacugccucuuauuggggaagcagacuguuugcaugagaaauauggaggccugaacaagagcaaaccauacuacaccggugagcacgccaaggcuauagggaauugccccaucugggugaagacaccgcuaaaacucgccaacggcacuaaguaucggccucccgcaaaacugcuuaaggaacgcggauuuuucggcgcuauugccggguuucuggagggagguugggaaggcaugaucgcgggguggcauggauacaccagucacggcgcccacgguguugcaguggcugccgauuugaaaucuacacaggaggcuauaaauaagauuaccaagaaccucaauucccugagcgaauuagaggucaaaaaccugcagcgacucucgggggccauggacgagcuucauaaugaaauccuggaguuggaugaaaagguggacgaccuaagagcagauacuaucucuucccaaauugagcuggccguacuccugucaaacgaaggcaucauuaauagugaggacgagcaccuucuggcuuuggaaaggaaacucaagaaaaugcugggaccaagcgcgguugagauaggcaacggguguuucgaaacgaagcauaagugcaaucagacaugcuuagaucggaucgcagccggaaccuuugacgcuggugaguucucccugccuacuuuugauucucuaaacauuaccgccgcaagccucaacgacgauggccuggacaaucacacaauccuuuuguauuacucaaccgccgcuaguucccuggccgugacucucaugaucgcaauuuucgucguguauauggucagccgugauaacgugucuuguucaauaugccuguga

SEQ ID NO: 149194 - RNA, 1758 nt, Artificial Sequence; identical to SEQ ID NO: 148654
  derived and/or modified sequence opt3 from hemagglutinin__InfluenzaB__AGX17906

SEQ ID NO: 149195 - RNA, 1758 nt, Artificial Sequence; identical to SEQ ID NO: 148654
  derived and/or modified sequence opt3 from hemagglutinin__InfluenzaB__AGX17917

SEQ ID NO: 149196 - RNA, 1758 nt, Artificial Sequence
  derived and/or modified sequence opt3 from hemagglutinin__InfluenzaB__AGX17928
augaagaccaucauugugcugcucauggucguuacaagcaacgccgacagaauaugcacuggcaucacguccucuaauucaccccacgugguaaaaaccgcuacacagggggaggugaacgucacuggagugauuccucuuaccacaaccccaacuaagagucauuucgcaaaucugaaagguacaaagaccaggggcaaauuguguccgaagugcuuaaacuguacggaucuggacguugcccuagggcggcccaagugcacuggaaauaucccuagcgcggaaguguccauucuccacgagguccgcccagugaccucuggcuguuuucccaucaugcaugaucgaacaaaaauacgucaacugccuaaccuucugagagguuacgaacacaucagguugucgacucauaauguaauuaacgcugagaaggccccagggggacccuauaaaaucggcaccucaggcagcugcccuaauguuacaaacgggaauggauucuuugcaaccauggccugggcugugccaaagaacgacaauaacaaaacggcaacuaauagucucacaauugaagucccguacaucuguaccgagggugaggaucagauaacuauuuggggcuuccacuccgacaacgaaacacagauggccaagcuguauggggauucuaagccccagaaauuuaccagcuccgcuaacggagugacgacccacuacgugucacaaaucggcgguuucccuaaucagacagaggacgggggacugccacagaguggccggauugucguugauuauauggugcaaaagagcggcaaaacugggaccaucacauaccagcgcggaauccucuuaccccagaagguauggugcgccucugguagauccaaagugauuaagggcacucugccucuuauaggggaagcggacuguuugcaugagaaauauggaggccugaacaagucaaagccauacuacaccggugagcacgcaaaagccaucgggaauugccccauuugggucaagacaccgcuaaaacucgcuaacggcaccaaguauaggccucccgccaaacugcuuaaggaacggggauuuuucggcgcaaucgcuggguuucuggagggagguugggaaggcaugauagccggguggcauggauacacuagccacggcgcgcacgguguggccguugcagcugauuugaagaguacgcaggaggccauuaauaaaaucacaaagaaccucaauucucuguccgaauuagaggugaaaaaccugcagcgccucagcggggcuauggacgagcuucauaaugaaauccuggaguuggaugaaaaggucgacgaccuacgagccgauaccauuucgucucaaaucgagcuggcagugcuccuguccaacgaaggcauuauaaauucagaggacgagcaccuucuggccuuggaaagaaaacucaagaagaugcugggaccaagugcuguagagaucggcaacggguguuucgaaacuaaacauaagugcaaucagaccugcuuagauaggauugcggcaggaacauuugacgccggugaguucagccugccuaccuuugauucccuaaacaucacugcugccucucucaaugacgauggccuggacaaccacacaauccuuuuguauuacagcacggcagccucaagucuggcuguuacccucaugauugccauauucguggucuauauggugucccgggauaacgucagcuguucuaucugccuguga

SEQ ID NO: 149197 - RNA, 1758 nt, Artificial Sequence; identical to SEQ ID NO: 148530
  derived and/or modified sequence opt3 from hemagglutinin__InfluenzaB__AGX17939

SEQ ID NO: 149198 - RNA, 1758 nt, Artificial Sequence; identical to SEQ ID NO: 148530
  derived and/or modified sequence opt3 from hemagglutinin__InfluenzaB__AGX17950

SEQ ID NO: 149199 - RNA, 1758 nt, Artificial Sequence; identical to SEQ ID NO: 148530
  derived and/or modified sequence opt3 from hemagglutinin__InfluenzaB__AGX17961

SEQ ID NO: 149200 - RNA, 1758 nt, Artificial Sequence; identical to SEQ ID NO: 148997
  derived and/or modified sequence opt3 from hemagglutinin__InfluenzaB__AGX17972

SEQ ID NO: 149201 - RNA, 1758 nt, Artificial Sequence; identical to SEQ ID NO: 148530
  derived and/or modified sequence opt3 from hemagglutinin__InfluenzaB__AGX17983

SEQ ID NO: 149202 - RNA, 1758 nt, Artificial Sequence; identical to SEQ ID NO: 148654
  derived and/or modified sequence opt3 from hemagglutinin__InfluenzaB__AGX17994

SEQ ID NO: 149203 - RNA, 1758 nt, Artificial Sequence
  derived and/or modified sequence opt3 from hemagglutinin__InfluenzaB__AGX18005
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauauaaaaucuacccaggaggcuauuaacaagaucacuaagaauuugaacucccucagcgaacuggaggucaaaaauuuacagcgacugucgggggccauggacgagcuccauaacgaaauccuugagcuggaugaaaagguggacgacuugagagcagauacgauuucuucccaaaucgagcuagccguacugcucucaaaugaaggcauuauaaacagugaggacgagcaucugcuugcucuggaaaggaaauugaagaaaaugcucggaccaagcgcgguugagaucggcaauggguguuucgaaacaaagcacaagugcaaccagaccugccuggaucggauugcagccggaacuuuugacgcuggugaguucuccuuaccuaccuuugauucucugaauaucacagccgcaagccuaaacgacgauggccucgacaaccacaccauccugcuuuauuacucaacugccgcuaguuccuuggccgugacacugaugauugcaauauucgucguguauauggucagccgugauaaugugucuuguucaaucugccucuga

SEQ ID NO: 149204 - RNA, 1758 nt, Artificial Sequence
  derived and/or modified sequence opt3 from hemagglutinin__InfluenzaB__AGX18016
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguauagagggugaggaucagauuacaguguggggcuuccacuccgacaacgaaacccagauggcuaagcuguauggggauucuaaaccccagaaguuuacuagcuccgccaauggagugacaacccacuacgucucacaaaucggcgguuucccuaaccagacggaggacgggggacugccacagaguggccgcauuguuguggauuauaugguacaaaagagcggcaaaaccgggacaaucacuuaccagagaggaauccucuuaccccagaagguguggugcgcgucugguagguccaaagucauuaagggcucacugccucuuauaggggaagcagacuguuugcaugagaaauauggaggccugaauaagagcaaaccauacuacaccggugagcacgccaaggcuaucgggaacugccccauuugggugaagacaccgcuaaaacucgccaauggcacuaaguaucggccucccgcaaaacugcuuaaggaacgcggauuuuucggcgcuaucgccggguuucuggagggagguugggaaggcaugauagcgggguggcauggauacaccagucacggcgcccacgguguugcaguggcugccgauuugaaaucuacacaggaggcuauuaacaagaucaccaagaaucucaacucccugagcgaauuagaggucaaaaaucugcagcgacucucgggggccauggacgagcuucauaacgaaauccuggaguuggaugaaaagguggacgaccuaagagcagauacuauuucuucccaaaucgagcuggccguacuccugucaaaugaaggcauuauaaacagugaggacgagcaccuucuggcuuuggaaaggaaacucaagaaaaugcugggaccaagcgcgguugagaucggcaauggguguuucgaaacgaagcauaagugcaaccagacaugcuuagaucggauugcagccggaaccuuugacgcuggugaguucucccugccuacuuuugauucucuaaauaucaccgccgcaagccucaacgacgauggccuggacaaccacacaauccuuuuguauuacucaaccgccgcuaguucccuggccgugacucucaugauugcaauauucgucguguauauggucagccgugauaaugugucuuguucaaucugccuguga

SEQ ID NO: 149205 - RNA, 1758 nt, Artificial Sequence; identical to SEQ ID NO: 149168
  derived and/or modified sequence opt3 from hemagglutinin__InfluenzaB__AGX18027

SEQ ID NO: 149206 - RNA, 1758 nt, Artificial Sequence; identical to SEQ ID NO: 148654
  derived and/or modified sequence opt3 from hemagglutinin__InfluenzaB__AGX18038

SEQ ID NO: 149207 - RNA, 1758 nt, Artificial Sequence; identical to SEQ ID NO: 148654
  derived and/or modified sequence opt3 from hemagglutinin__InfluenzaB__AGX18049

SEQ ID NO: 149208 - RNA, 1758 nt, Artificial Sequence; identical to SEQ ID NO: 148654
  derived and/or modified sequence opt3 from hemagglutinin__InfluenzaB__AGX18060

SEQ ID NO: 149209 - RNA, 1758 nt, Artificial Sequence; identical to SEQ ID NO: 148530
  derived and/or modified sequence opt3 from hemagglutinin__InfluenzaB__AGX18071

SEQ ID NO: 149210 - RNA, 1758 nt, Artificial Sequence; identical to SEQ ID NO: 149190
  derived and/or modified sequence opt3 from hemagglutinin__InfluenzaB__AGX18082

SEQ ID NO: 149211 - RNA, 1758 nt, Artificial Sequence; identical to SEQ ID NO: 149190
  derived and/or modified sequence opt3 from hemagglutinin__InfluenzaB__AGX18093

SEQ ID NO: 149212 - RNA, 1758 nt, Artificial Sequence; identical to SEQ ID NO: 148997
  derived and/or modified sequence opt3 from hemagglutinin__InfluenzaB__AGX18104

SEQ ID NO: 149213 - RNA, 1758 nt, Artificial Sequence; identical to SEQ ID NO: 148654
  derived and/or modified sequence opt3 from hemagglutinin__InfluenzaB__AGX18115

SEQ ID NO: 149214 - RNA, 1758 nt, Artificial Sequence; identical to SEQ ID NO: 148654
  derived and/or modified sequence opt3 from hemagglutinin__InfluenzaB__AGX18126

SEQ ID NO: 149215 - RNA, 1758 nt, Artificial Sequence; identical to SEQ ID NO: 148530
  derived and/or modified sequence opt3 from hemagglutinin__InfluenzaB__AGX18137

SEQ ID NO: 149216 - RNA, 1758 nt, Artificial Sequence; identical to SEQ ID NO: 149190
  derived and/or modified sequence opt3 from hemagglutinin__InfluenzaB__AGX18148

SEQ ID NO: 149217 - RNA, 1758 nt, Artificial Sequence; identical to SEQ ID NO: 148530
  derived and/or modified sequence opt3 from hemagglutinin__InfluenzaB__AGX18159

SEQ ID NO: 149218 - RNA, 1758 nt, Artificial Sequence; identical to SEQ ID NO: 148530
  derived and/or modified sequence opt3 from hemagglutinin__InfluenzaB__AGX18170

SEQ ID NO: 149219 - RNA, 1758 nt, Artificial Sequence; identical to SEQ ID NO: 149190
  derived and/or modified sequence opt3 from hemagglutinin__InfluenzaB__AGX18181

SEQ ID NO: 149220 - RNA, 1758 nt, Artificial Sequence
  derived and/or modified sequence opt3 from hemagglutinin__InfluenzaB__AGX18192
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccaccaacggagugacgacccacuacgugucacaaaucggcgguuucccuaaucagacagaggacgggggacugccacagaguggccggauugucguugauuauauggugcagaagcccggcaaaacugggaccaucacauaccaacgcggaauccucuuaccucagaagguauggugcgccagcgguagaucuaaagugauuaagggcucccugccacuuauaggggaagcggacuguuugcaugagaaauauggaggccugaacaagucaaagcccuacuacacuggugagcacgcaaaagccaucgggaauugcccgauuugggucaagaccccucuaaaacucgcuaacggcacaaaguauaggcccccagccaaacugcuuaaggaacggggauuuuucggcgcaaucgcuggguuucuggagggagguugggaaggcaugauagccggguggcauggauacaccagccacggcgcgcacgguguggccguugcagcugauuugaagaguacucaggaggccauuaauaaaaucacgaagaaccucaauucucuguccgaauuagaggugaaaaaccugcagcgccucagcucggcuauggacgagcuucauaaugaaauccuggaguuggaugaaaaggucgacgaccuacgagccgauacaauuucuucccaaaucgagcuggcagugcuccugucaaacgaagggauuauaaauagugaggacgagcaccuucuggccuuggaaagaaaacucaagaagaugcugggcccuagcgcuguagagaucggaaacggcuguuucgaaaccaaacauaagugcaaucagacuugcuuagauaggauugcggcagggaccuuugacgccggagaguucucccugcccacauuugauucucuaaacaucaccgcugccagccucaaugacgauggucuggacaaccacacuauccuuuuguauuacucaacagcagccaguucccuggcuguuacgcucaugauugccauauucguggucuauauggugagccgggauaacgucucuuguucaaucugccuguga

SEQ ID NO: 149221 - RNA, 1758 nt, Artificial Sequence; identical to SEQ ID NO: 149168
  derived and/or modified sequence opt3 from hemagglutinin__InfluenzaB__AGX18203

SEQ ID NO: 149222 - RNA, 1758 nt, Artificial Sequence
  derived and/or modified sequence opt3 from hemagglutinin__InfluenzaB__AGX18214
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaacuggcaccucaggcagcugcccuaauguuacaaacgggaauggauucuuugccaccauggcuugggcagugccaaagaacgacaauaacaaaacggccacuaauagucucacaaucgaagucccguacauuuguaccgagggugaggaucagaucacuauauggggcuuccacuccgacaacgaaacacagauggcuaagcuguauggggauucuaagccccagaaauuuaccagcuccgccaacggagugacgacccacuacgugucacaaauuggcgguuucccuaaucagacagaggacgggggacugccacagaguggccggaucgucguugauuauauggugcaaaagagcggcaaaacugggaccauuacauaccagcgcggaauccucuuaccccagaagguauggugcgcgucugguagauccaaagugaucaagggcucacugccucuuauuggggaagcagacuguuugcaugagaaauauggaggccugaacaagagcaagccauacuacacuggugagcacgccaaagcuauagggaauugccccaucugggucaagaccccgcuaaaacucgccaacggcacaaaguauaggccucccgcaaaacugcuuaaggaacggggauuuuucggcgcuauugccggguuucuggagggagguugggaaggcaugaucgcgggguggcauggauacaccagucacggcgcccacgguguggcaguugcugccgauuugaagucuacucaggaggcuauaaauaaaauuacgaagaaccucaauucccugagcgaauuagaggugaaaaaccugcagcgccucucgggggccauggacgagcuucauaaugaaauccuggaguuggaugaaaaggucgacgaccuacgagcagauacaaucucuucccaaauugagcuggccgugcuccugucaaacgaaggcaucauuaauagugaggacgagcaccuucuggcuuuggaaagaaaacucaagaagaugcugggaccaagcgcgguagagauaggcaacggguguuucgaaaccaaacauaagugcaaucagacuugcuuagauaggaucgcagccggaaccuuugacgcuggugaguucucccugccuacauuugauucucuaaacauuaccgccgcaagccucaaugacgauggccuggacaaccacaucauccuuuuguauuacucaacugccgcuaguucccuggccguuacacucaugauugcaauauucguggucuauauggugagccgggauaacgucucuuguucaaucugccuguga

SEQ ID NO: 149223 - RNA, 1758 nt, Artificial Sequence
  derived and/or modified sequence opt3 from hemagglutinin__InfluenzaB__AGX18225
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaaucgcaucacuaaaaaccucaauucccugagcgaauuagaggugaagaaccugcagcgacucucgggggccauggacgagcuucauaaugaaauccuggaguuggaugaaaaagucgacgaccuaagagcagauacgauuucuucccaaaucgagcuggccgugcuccugucaaacgaaggcauuauaaauagugaggacgagcaccuucuggcuuuggaaaggaagcucaaaaagaugcugggaccaagcgcgguagagaucggcaacggguguuucgaaacaaagcauaaaugcaaucagaccugcuuagaucggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgugauaacgucucuuguucaaucugccuguga

SEQ ID NO: 149224 - RNA, 1758 nt, Artificial Sequence
  derived and/or modified sequence opt3 from hemagglutinin__InfluenzaB__AGX18236
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauaugaugcaaaagagcggcaaaacagggacuaucaccuaccagcgcggaauccucuuaccccagaagguguggugcgcgucugguagauccaaaguaauuaagggcucacugccucuuauaggggaagcagacuguuugcaugagaaauauggaggccugaacaagagcaagccauacuacacaggugagcacgccaaagcuaucgggaauugccccauuugggugaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacggugucgcaguggcugccgauuugaagucuacccaggaggcuauuaauaaaaucacuaagaaccucaauucccugagcgaauuagagguuaaaaaccugcagcgccucucgggggccauggacgagcuucauaaugaaauccuggaguuggaugaaaagguggacgaccuacgagcagauacgauuucuucccaaaucgagcuggccguccuccugucaaacgaaggcauuauaaauagugaggacgagcaccuucuggcuuuggaaagaaaacucaagaagaugcugggaccaagcgcgguggagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguaacacucaugauugcaauauucguuguguauauggucagccgggauaacgugucuuguucaaucugccuguga

SEQ ID NO: 149225 - RNA, 1758 nt, Artificial Sequence; identical to SEQ ID NO: 148581
  derived and/or modified sequence opt3 from hemagglutinin__InfluenzaB__AGX18247

SEQ ID NO: 149226 - RNA, 1758 nt, Artificial Sequence
  derived and/or modified sequence opt3 from hemagglutinin__InfluenzaB__AGX18258
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaaaaauaagaccgccacgaacagucucacuauugaagucccguacaucuguacagagggugaggaucagauaaccauuuggggcuuccacuccgacaaugaaacucagauggcuaagcuguauggggauucuaaaccccagaaguuuacaagcuccgccaacggagugaccacgcacuacgugucacaaaucggcgguuucccuaaccagaccgaggacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcacacugccucuuauaggggaagcagacuguuugcaugagaaguauggaggccugaauaagucaaaaccauacuacacuggugagcacgccaaggcuaucgggaacugccccauuugggucaaaaccccgcuaaagcucgccaauggcacaaaauauaggccucccgcaaagcugcuuaaggaacggggauuuuucggcgcuaucgccggguuucuggagggagguugggaaggcaugauagcgggguggcauggauacaccagccacggcgcccacgguguggcaguugcugccgauuugaaaaguacucaggaggcuauuaacaagaucacgaaaaaucucaacucucuguccgaauuagaggugaagaaucugcagcgccucagcggggccauggacgagcuucauaacgaaauccuggaguuggaugaaaaagucgacgaccuacgagcagauacaauuucgucucaaaucgagcuggccgugcuccuguccaaugaaggcauuauaaacucagaggacgagcaccuucuggcuuuggaaagaaagcucaagaaaaugcugggaccaagugcgguagagaucggcaauggguguuucgaaaccaagcauaaaugcaaccagacuugcuuagauaggauugcagccggaaccuuugacgcuggugaguucagccugccuacauuugauucccuaaauaucaccgccgcaucucucaacgacgauggccuggacaaucacacuauccuuuuguauuacagcacagccgcuucaagucuggccguuacgcucaugauugcaauauucguggucuauauggugucccgggauaacgucagcuguucuaucugccuguga

SEQ ID NO: 149227 - RNA, 1758 nt, Artificial Sequence; identical to SEQ ID NO: 148530
  derived and/or modified sequence opt3 from hemagglutinin__InfluenzaB__AGX18280

SEQ ID NO: 149228 - RNA, 1758 nt, Artificial Sequence
  derived and/or modified sequence opt3 from hemagglutinin__InfluenzaB__AGX18291
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgugucugguagauccaaagucauuaagggcucacugccucuuauaggggaagcggacuguuugcaugagaaauauggaggccugaacaagagcaagccauacuacacaggugagcacgcaaaagccaucgggaauugccccauuugggugaagacuccgcuaaaacucgcuaacggcaccaaguauaggccucccgccaaacugcuuaaggaacggggauuuuucggcgcaaucgcuggguuucuggagggagguugggaaggcaugauagccggguggcauggauacacaagucacggcgcgcacgguguugccguggcagcugauuugaagucuacccaggaggccauuaauaaaaucacuaagaaccucaauucccugagcgaauuagaggucaaaaaccugcagcgccucucgggggcuauggacgagcuucauaaugaaauccuggaguuggaugaaaagguggacgaccuacgagccgauacgauuucuucccaaaucgagcuggcaguacuccugucaaacgaaggcauuauaaauagugaggacgagcaccuucuggccuuggaaagaaaacucaagaagaugcugggaccaagcgcuguugagaucggcaacggguguuucgaaacaaaacauaagugcaaucagaccugcuuagauaggauugcggcaggaacuuuugacgccggugaguucucccugccuaccuuugauucucuaaacaucacagcugccagccucaaugacgauggccuggacaaccacaccauccuuuuguauuacucaacugcagccaguucccuggcugugacacucaugauugccauauucgucguguauauggucagccgggauaacgugucuuguucaaucugccuguga

SEQ ID NO: 149229 - RNA, 1758 nt, Artificial Sequence
  derived and/or modified sequence opt3 from hemagglutinin__InfluenzaB__AGX18302
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacaagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccauuuggggcuuccacuccgacaacgagacucagauggcuaagcuguauggggauucuaaaccccagaaguuuacaagcuccgccaacggagugaccacgcacuacgugucacaaaucggcgguuucccuaaucagaccgaagacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcacacugccucuuauaggggaggcagacuguuugcaugaaaaguauggaggccugaacaagucaaaaccauacuacacuggugagcacgccaaggcuaucgggaauugccccauuugggucaaaaccccgcuaaagcucgccaacggcacaaaauauaggccucccgcaaagcugcuuaaggagcggggauuuuucggcgcuaucgccggguuucuggaaggagguugggagggcaugauagcgggguggcauggauacaccagccacggcgcccacgguguggcaguugcugccgauuugaaaaguacucaggaagcuauuaauaagaucacgaaaaaccucaauucucuguccgaguuagaagugaagaaccugcagcgccucagcggggccauggacgagcuucauaaugagauccuggaauuggaugagaaagucgacgaccuacgagcagauacaauuucgucucaaaucgaacuggccgugcuccuguccaacgagggcauuauaaauucagaagacgagcaccuucuggcuuuggagagaaagcucaagaaaaugcugggaccaagugcgguagaaaucggcaacggguguuucgagaccaagcauaaaugcaaucagacuugcuuagauaggauugcagccggaaccuuugacgcuggugaguucagccugccuacauuugauucccuaaacaucaccgccgcaucucucaaugacgauggccuggacaaccacacuauccuuuuguauuacagcacagccgcuucaagucuggccguuacgcucaugauugcaauauucguggucuauauggugucccgggauaacgucagcuguucuaucugccuguga

SEQ ID NO: 149230 - RNA, 1758 nt, Artificial Sequence; identical to SEQ ID NO: 148530
  derived and/or modified sequence opt3 from hemagglutinin__InfluenzaB__AGX18313

SEQ ID NO: 149231 - RNA, 1758 nt, Artificial Sequence
  derived and/or modified sequence opt3 from hemagglutinin__InfluenzaB__AGX18324
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaagcucagauggccaagcuguauggggauucuaagccccagaaauuuacuagcuccgcgaacggagugacaacccacuacgugucacaaaucggcgguuucccuaaucagacggaggacgggggacugccacagaguggccggauugucguugauuauauggugcaaaagagcggcaaaaccgggacaaucacuuaccagcgcggaauccucuuaccccagaagguauggugcgcaucugguagauccaaagugauuaagggcucacugccucuuauaggggaagccgacuguuugcaugagaaauauggaggccugaacaagagcaagccauacuacaccggugagcacgcuaaagccaucgggaauugccccauuugggucaagacaccgcuaaaacucgcaaacggcacuaaguauaggccucccgcuaaacugcuuaaggaacggggauuuuucggcgccaucgcgggguuucuggagggagguugggaaggcaugauagccggguggcauggauacaccagucacggcgcacacgguguggcuguugccgcugauuugaagucuacacaggaggccauuaauaaaaucaccaagaaccucaauucccugagcgaauuagaggugaaaaaccugcagcgccucucgggggcaauggacgagcuucauaaugaaauccuggaguuggaugaaaaggucgacgaccuacgagccgauacuauuucuucccaaaucgagcuggcugugcuccugucaaacgaaggcauuauaaauagugaggacgagcaccuucuggcguuggaaagaaaacucaagaagaugcugggaccaagcgcaguagagaucggcaacggguguuucgaaacgaaacauaagugcaaucagacaugcuuagauaggauugccgcuggaaccuuugacgccggugaguucucccugccuacuuuugauucucuaaacaucaccgcagccagccucaaugacgauggccuggacaaccacacaauccuuuuguauuacucaaccgcugccaguucccuggcaguuacucucaugauugcgauauucguggucuauauggugagccgggauaacgucucuuguucaaucugccuguga

SEQ ID NO: 149232 - RNA, 1758 nt, Artificial Sequence; identical to SEQ ID NO: 149190
  derived and/or modified sequence opt3 from hemagglutinin__InfluenzaB__AGX18335

SEQ ID NO: 149233 - RNA, 1758 nt, Artificial Sequence
  derived and/or modified sequence opt3 from hemagglutinin__InfluenzaB__AGX18346
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugaagacggccuggauaaccacaccauccuuuuguauuacucaacugccgcuaguucccuggccguuacacucaugauugcaauauucguggucuauauggugagccgggacaacgucucuuguucaaucugccuguga

SEQ ID NO: 149234 - RNA, 1758 nt, Artificial Sequence
  derived and/or modified sequence opt3 from hemagglutinin__InfluenzaB__AGX18357
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccgccccaacaaagagucauuucgcgaaucugaaagguaccaagacuaggggcaaauuguguccgaagugcuuaaacuguacagaucuggacguugcucuagggcggcccaagugcaccggaaauaucccuagcgccgaaguguccauucuccacgagguccgcccagugacgucuggcuguuuucccaucaugcaugaucgaacuaaaauacgucaacugccuaaccuucugagagguuacgaacacaucagguugucgacccauaauguaauuaacgcagagaaggccccagggggacccuauaaaaucggcacaucaggcagcugcccuaauguuacuaacgggaauggauucuuugcuaccauggcaugggccgugccaaagaacgacaauaacaaaacagcuaccaauagucucacgauugaagucccguacaucuguacugagggugaggaucagauaacaauuuggggcuuccacuccgacaaggaaacccagauggccaagcuguauggggauucuaaaccccagaaguuuacuagcuccgcgaacggagugacaacccacuacgugucacaaaucggcgguuucccuaaccagacggaggacgggggacugccacagaguggccggauugucguugauuauauggugcagaaacccggcaagaccgggacaaucacuuaccaacgcggaauccucuuaccucagaaaguauggugcgcaagcgguagaucuaaggugauuaaaggcucccugccacuuauaggggaagccgacuguuugcaugagaaguauggaggccugaauaagucaaaacccuacuacaccggugagcacgcuaaggccaucgggaacugcccgauuugggucaaaacaccucuaaagcucgcaaauggcacuaaauauaggcccccagcuaagcugcuuaaggaacggggauuuuucggcgccaucgcgggguuucuggagggagguugggaaggcaugauagccggguggcauggauacaccagccacggcgcacacgguguggcuguugccgcugauuugaaaaguacacaggaggccauuaacaagaucaccaaaaaucucaacucucuguccgaauuagaggugaagaaucugcagcgccucagcucggcaauggacgagcuucauaacgaaauccuggaguuggaugaaaaagucgacgaccuacgagccgauacuauuucuucccaaaucgagcuggcugugcuccugucaaaugaagggauuauaaacagugaggacgagcaccuucuggcguuggaaagaaagcucaagaaaaugcugggcccuagcgcaguagagaucggaaauggcuguuucgaaacgaagcauaaaugcaaccagacaugcuuagauaggauugccgcugggaccuuugacgccggagaguucucccugcccacuuuugauucucuaaauaucaccgcagccagccucaacgacgauggucuggacaaucacacaauccuuuuguauuacucaaccgcugccaguucccuggcaguuacucucaugauugcgauauucguggucuauauggugagccgggauaacgucucuuguucaaucugccuguga

SEQ ID NO: 149235 - RNA, 1758 nt, Artificial Sequence
  derived and/or modified sequence opt3 from hemagglutinin__InfluenzaB__AGX18368
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccgccccaacaaagagucauuucgcgaaucugaaagguaccaagacuaggggcaaauuguguccgaagugcuuaaacuguacagaucuggacguugcucuagggcggcccaagugcaccggaaauacgccuagcgccgaaguguccauccuccacgagguccgcccagugacuucuggcuguuuucccauuaugcaugaucgaaccaaaauccgucaacugccuaaccuucugagagguuacgaacacauaagguugucgaaucauaacguaaucaaugcagagaaggccccagggggacccuauaaaauuggcacaucaggcagcugcccuaacguuacuaaugggaacggauucuuugcuaccauggcaugggccgugccaaagaaugacaacaauaaaacagcuaccaacagucucacgaucgaagucccguacauuuguacugagggugaggaucagaucacaauauggggcuuccacuccgacaacgaaacccagauggccaagcuguauggggauucuaagccccagaaauuuacuagcuccgcgaauggagugacaacccacuacgugucacaaauuggcgguuucccuaaccagacggaggacgggggacugccacagaguggccggaucgucguugauuauauggugcagaagcccggcaaaaccgggacaauuacuuaccaacgcggaauccucuuaccucagaagguauggugcgcaagcgguagaucuaaagugaucaagggcucccugccacuuauuggggaagccgacuguuugcaugagaaauauggaggccugaauaagucaaagcccuacuacaccggugagcacgcuaaagccauagggaacugcccgaucugggucaagacaccucuaaaacucgcaaauggcacuaaguauaggcccccagcuaaacugcuuaaggaacggggauuuuucggcgccauugcgggguuucuggagggagguugggaaggcaugaucgccggguggcauggauacaccagccacggcgcacacgguguggcuguugccgcugauuugaagaguacacaggaggccauaaacaaaauuaccaagaaucucaacucucuguccgaauuagaggugaaaaaucugcagcgccucagcucggcaauggacgagcuucauaacgaaauccuggaguuggaugaaaaggucgacgaccuacgagccgauacuaucucuucccaaauugagcuggcugugcuccugucaaaugaagggaucauuaacagugaggacgagcaccuucuggcguuggaaagaaaacucaagaagaugcugggcccuagcgcaguagagauaggaaauggcuguuucgaaacgaaacauaagugcaaccagacaugcuuagauaggaucgccgcugggaccuuugacgccggagaguucucccugcccacuuuugauucucuaaauauuaccgcagccagccucaacgacgauggucuggacaaccacacaauccuuuuguauuacucaaccgcugccaguucccuggcaguuacucucaugaucgcgauuuucguggucuauauggugagccgggauaaugucucuuguucaauaugccuguga

SEQ ID NO: 149236 - RNA, 1758 nt, Artificial Sequence; identical to SEQ ID NO: 148654
  derived and/or modified sequence opt3 from hemagglutinin__InfluenzaB__AGX18379

SEQ ID NO: 149237 - RNA, 1758 nt, Artificial Sequence; identical to SEQ ID NO: 149190
  derived and/or modified sequence opt3 from hemagglutinin__InfluenzaB__AGX18390

SEQ ID NO: 149238 - RNA, 1758 nt, Artificial Sequence
  derived and/or modified sequence opt3 from hemagglutinin__InfluenzaB__AGX18401
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccgccccaacaaagagucauuucgcgaaucugaaagguaccaagacuaggggcaaauuguguccgaagugcuuaaacuguacagaucuggacguugcucuagggcggcccaagugcaccggaaauaucccuagcgccgaaguguccauucuccacgagguccgcccagugacgucuggcuguuuucccaucaugcaugaucgaacuaaaauacgucaacugccuaaccuucugagagguuacgaacacaucagguugucgacccauaauguaauuaacgcagagaaggccccagggggacccuauaaaaucggcacaucaggcagcugcccuaauguuacuaacgggaauggauucuuugcuaccauggcaugggccgugccaaagaacgacaauaacaaaacagcuaccaauagucucacgauugaagucccguacaucuguacugagggugaggaucagauaacaauuuggggcuuccacuccgacaacgaaauccagauggccaagcuguauggggauucuaagccccagaaauuuaccagcuccgcgaacggagugacuacacacuacgugucacaaauuggcgguuucccuaaucagaccgaggacgggggacugccacagaguggccggaucgucguugauuauauggugcagaagcccggcaaaacggggaccaucacauaccaacgcgguauucucuuaccucagaagguauggugcgcaagcggaagaucuaaagugauaaagggcucccugccacuuaucggggaagccgacuguuugcaugagaaauauggaggccugaacaagucaaagcccuacuacacuggugagcacgcuaaagccauugggaauugcccgaucugggucaagaccccucuaaaacucgcaaacggcacaaaguauaggcccccagcuaaacugcuuaaggaacggggauuuuucggcgccauagcgggguuucuggagggagguugggaaggcaugauugccggguggcauggauacacuagccacggcgcacacgguguggcuguugccgcugauuugaagaguacccaggaggccaucaauaaaaucacaaagaaccucaauucucuguccgaauuagaggugaaaaaccugcagcgccucagcucggcaauggacgagcuucauaaugaaauucuggaguuggaugaaaaggucgacgaccuacgagccgauaccaucucuucccaaauugagcuggcugugcuccugucaaacgaagggauaaucaauagugaggacgagcaccuucuggcguuggaaagaaaacucaagaagaugcugggcccuagcgcaguagagauuggaaacggcuguuucgaaacuaaacauaagugcaaucagacgugcuuagauaggaucgccgcugggacauuugacgccggagaguucucccugcccaccuuugauucucuaaacaucacugcagccagccucaaugacgauggucuggacaaccacaccauucuuuuguauuacucaacagcugccaguucccuggcaguuacccucaugauagcgaucuucguggucuauauggugagccgggauaacgucucuuguucaauuugccuguga

SEQ ID NO: 149239 - RNA, 1758 nt, Artificial Sequence
  derived and/or modified sequence opt3 from hemagglutinin__InfluenzaB__AGX18412
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgaaucauaacguaauuaaugccgagaaggcaccagggggacccuauaaaaucggcacaucaggcagcugcccuaacguuacuaaugggaacggauucuuugccaccauggcuugggcagugccaaagaaugacaacaauaaaacagccaccaacagucucacgauugaagucccguacaucuguacugagggugaggaucagauaacaauuuggggcuuccacuccgacaacgaagcucagauggccaagcuguauggggauucuaagccccagaaauuuaccagcuccgcgaauggagugacuacacacuacgugucacaaaucggcgguuucccuaaccagaccgaggacgggggacugccacagaguggccggauugucguugauuauauggugcagaagaguggcaaaacggggaccaucacauaccaacgcggaauccucuuaccccagaagguauggugcgcaucugguagauccaaagugauuaagggcucacugccucuuauaggggaagccgacuguuugcaugagaaauauggaggccugaauaagagcaagccauacuacacuggugagcacgcuaaagccaucgggaacugccccauuugggucaagaccccgcuaaaacucgcaaauggcacaaaguauaggccucccgcuaaacugcuuaaggaacggggauuuuucggcgccaucgcgggguuucuggagggagguugggaaggcaugauagccggguggcauggauacacuagccacggcgcacacgguguggcuguugccgcugauuugaagucuacccaggaggccauuaacaaaaucacaaagaaucucaacucccugagcgaauuagaggugaaaaaucugcagcgccucucgggggcaauggacgagcuucauaacgaaauccuggaguuggaugaaaaggucgacgaccuacgagccgauaccauuucuucccaaaucgagcuggcugugcuccugucaaaugaaggcauuauaaacagugaggacgagcaccuucuggcguuggaaagaaaacucaagaagaugcugggaccaagcgcaguagagaucggcaauggguguuucgaaacuaaacauaagugcaaccagacgugcuuagauaggauugccgcuggaacauuugacgccggugaguucucccugccuaccuuugauucucuaaauaucacugcagccagccucaacgacgauggccuggacaaccacaccauccuuuuguauuacucaacagcugccaguucccuggcaguuacccucaugauugcgauauucguggucuauauggugagccgggauaaugucucuuguucaaucugccuguga

SEQ ID NO: 149240 - RNA, 1758 nt, Artificial Sequence; identical to SEQ ID NO: 148997
  derived and/or modified sequence opt3 from hemagglutinin__InfluenzaB__AGX18423

SEQ ID NO: 149241 - RNA, 1755 nt, Artificial Sequence
  derived and/or modified sequence opt3 from hemagglutinin__InfluenzaB__AGX18424
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaucaagagucauuucgccaaucugaaagguaccaggacucggggcaaguuguguccggauugcuuaaacuguacagaccuggauguugcgcuagggcgccccaugugcgugggaaccacgccuagcgcuaaagccuccauucuccacgaaguccgaccagugacuucuggcuguuuucccaucaugcaugaccguaccaagauaagacaacugccuaaucuucugagggguuacgagaacauccgguugucgacacagaauguaauugaugcagaaaaggcccucgggggaccauaucgccugggcacuucaggcagcugccccaacgcuaccaguaaauccggguucuuugcaacaauggccugggcuguuccuaaggacaauaacaaaaaugccaccaacccacugacgguggaggucccguacaucuguacugaaggagaggaucagauuacagugugggguuuccacucugacgauaagacccagaugaaaaaucucuauggcgacagcaacccccaaaaguuuacuuccucagcgaauggggugacaacccauuacgucagucagaucggaggcuucccugaucagacggaggacgguggguuaccacagagcggaagaauaguuguggauuauaugguacaaaagcccggcaaaaccggcacaauuguguaccagcgcgggguccugcuuccucagaagguguggugcgcaucuggacgguccaaaguuaucaaggguucauugccacugauuggcgaagccgacugucuacacgagaaauaugggggacucaacaagagcaaacccuacuacacuggcgaacacgcuaaggccaucgguaacugcccgaucugggugaagaccccucugaaacuugcaaaugggacaaaguauaggcccccagcuaaacuguugaaggagcgaggcuuuuucggagccauugcgggcuuucucgaagggggaugggaagguaugauagccggcuggcauggguacaccagucacggagcacauggcgucgcuguggccgcugaccugaaaucuacucaggaggccaucaacaagauuacaaagaauuuaaacucccugagcgaacucgagguuaaaaaucuucaaagacugucgggugcaauggaugaauugcacaacgagauccuagagcuggacgaaaagguagaugaccucagggccgauaccauaucuucccagauugagcuggcugugcuucugucaaaugaagggaucaucaacagugaggacgaacacuugcucgcgcuggagcggaaauuaaagaaaaugcugggcccuagcgcagucgauauuggaaauggcuguuucgagacuaagcauaagugcaaccagacgugccuagaccguaucgccgcugggacauuuaaugccggagaguucucccuccccaccuuugauucucugaacauuacugcagccagccuuaaugacgaugguuuggacaaccacaccauacugcucuauuacucaacagcugccaguucccuggcagugacccuuaugcuggcgaucuucauugucuauauggugagccgcgacaauguuucuuguucaaucugcuuguga

SEQ ID NO: 149242 - RNA, 1758 nt, Artificial Sequence
  derived and/or modified sequence opt3 from hemagglutinin__InfluenzaB__AGX18435
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaauccagauggcuaagcuguauggggauucuaagccccagaaauuuacuagcuccgccaacggagugacaacccacuacgugucacaaauuggcgguuucccuaaucagacggaggacgggggacugccacagaguggccggaucgucguugauuauauggugcaaaagagcggcaaaaccgggacaaucacuuaccagcgcgguauucucuuaccccagaagguauggugcgcgucuggaagauccaaagugauaaagggcucacugccucuuaucggggaagcagacuguuugcaugagaaauauggaggccugaacaagagcaagccauacuacaccggugagcacgccaaagcuauugggaauugccccaucugggucaagacaccgcuaaaacucgccaacggcacuaaguauaggccucccgcaaaacugcuuaaggaacggggauuuuucggcgcuauagccggguuucuggagggagguugggaaggcaugauugcgggguggcauggauacaccagucacggcgcccacgguguggcaguugcugccgauuugaagucuacacaggaggcuaucaauaaaaucaccaagaaccucaauucccugagcgaauuagaggugaaaaaccugcagcgccucucgggggccauggacgagcuucauaaugaaauucuggaguuggaugaaaaggucgacgaccuacgagcagauacuaucucuucccaaauugagcuggccgugcuccugucaaacgaaggcauaaucaauagugaggacgagcaccuucuggcuuuggaaagaaaacucaagaagaugcugggaccaagcgcgguagagauuggcaacggguguuucgaaacgaaacauaagugcaaucagacaugcuuagauaggaucgcagccggaaccuuugacgcuggugaguucucccugccuacuuuugauucucuaaacaucaccgccgcaagccucaaugacgauggccuggacaaccacacaauucuuuuguauuacucaaccgccgcuaguucccuggccguuacucucaugauagcaaucuucguggucuauauggugagccgggauaacgucucuuguucaauuugccuguga

SEQ ID NO: 149243 - RNA, 1758 nt, Artificial Sequence; identical to SEQ ID NO: 148654
  derived and/or modified sequence opt3 from hemagglutinin__InfluenzaB__AGX18446

SEQ ID NO: 149244 - RNA, 1758 nt, Artificial Sequence; identical to SEQ ID NO: 149190
  derived and/or modified sequence opt3 from hemagglutinin__InfluenzaB__AGX18457

SEQ ID NO: 149245 - RNA, 1758 nt, Artificial Sequence; identical to SEQ ID NO: 148997
  derived and/or modified sequence opt3 from hemagglutinin__InfluenzaB__AGX18468

SEQ ID NO: 149246 - RNA, 1758 nt, Artificial Sequence; identical to SEQ ID NO: 149190
  derived and/or modified sequence opt3 from hemagglutinin__InfluenzaB__AGX18479

SEQ ID NO: 149247 - RNA, 1758 nt, Artificial Sequence; identical to SEQ ID NO: 148530
  derived and/or modified sequence opt3 from hemagglutinin__InfluenzaB__AGX18490

SEQ ID NO: 149248 - RNA, 1758 nt, Artificial Sequence
  derived and/or modified sequence opt3 from hemagglutinin__InfluenzaB__AGX18512
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggccgguuguguccgaagugcuuaaacuguaccgaucuggacguugcgcuagggcgccccaaaugcacgggaaauaucccuagcgcucgaguguccauucuccacgagguccguccagugacuucuggcuguuuucccaucaugcaugauagaaccaagauaaggcaacugccuaaccuucugcgggguuacgaacacauccgcuugucgacacauaauguaauuaacgccgagaaugcaccagggggacccuauaagaucggcacuucaggcagcugcccuaacguuaccaaugggaacggauucuuugccacaauggcuugggcagugccaaagaaugacaacaauaagaccgccacgaacagucucacuauugaagucccguacaucuguacagagggugaggaucagauaaccguguggggcuuccacuccgacaacgaaacucagauggcuaaacuguauggggauucuaagccccagaaauuuacaagcuccgccaauggagugaccacgcacuacgucucacaaauuggcgguuucccuaaccagaccgaggacgggggacugccacagaguggcagaaucguuguggauuauaugguacagaaaagcggcaagacagggacuauuaccuaccaaaggggaauccucuuaccccagaaaguguggugcgcgucuggucgguccaaggucaucaaaggcucacugccucuuauuggggaagcagacuguuugcaugagaaguauggaggccugaauaaaagcaagccauacuacacaggugagcacgccaaagcuauagggaacugccccaucugggugaagacuccgcuaaagcucgccaauggcaccaaauaucgcccucccgcaaagcugcuuaaagaacgaggauuuuucggcgcuauugccggguuucuggagggagguugggaaggcaugaucgcgggguggcauggauacacaagucacggcgcccacgguguugcaguggcugccgauuugaagucuacccaggaggcuauaaacaaaauuacuaagaaucucaacucccugagcgaauuagaggucaagaaucugcagagacucucgggggccauggacgagcuucauaacgaaauccuggaguuggaugaaaaaguggacgaccuaagggcagauacgaucucuucccaaauugagcuggccguacuccugucaaaugaaggcaucauuaacagugaggacgagcaccuucuggcuuuggaacggaagcucaaaaagaugcugggaccaagcgcgguugagauaggcaauggguguuucgaaacaaaacauaagugcaaccagaccugcuuagaucguaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgcgauaaugugucuuguucaauaugccuguga

SEQ ID NO: 149249 - RNA, 1758 nt, Artificial Sequence; identical to SEQ ID NO: 148530
  derived and/or modified sequence opt3 from hemagglutinin__InfluenzaB__AGX18523

SEQ ID NO: 149250 - RNA, 1758 nt, Artificial Sequence; identical to SEQ ID NO: 148530
  derived and/or modified sequence opt3 from hemagglutinin__InfluenzaB__AGX18534

SEQ ID NO: 149251 - RNA, 1758 nt, Artificial Sequence; identical to SEQ ID NO: 148591
  derived and/or modified sequence opt3 from hemagglutinin__InfluenzaB__AGX18545

SEQ ID NO: 149252 - RNA, 1758 nt, Artificial Sequence; identical to SEQ ID NO: 148530
  derived and/or modified sequence opt3 from hemagglutinin__InfluenzaB__AGX18556

SEQ ID NO: 149253 - RNA, 1758 nt, Artificial Sequence; identical to SEQ ID NO: 148530
  derived and/or modified sequence opt3 from hemagglutinin__InfluenzaB__AGX18567

SEQ ID NO: 149254 - RNA, 1758 nt, Artificial Sequence
  derived and/or modified sequence opt3 from hemagglutinin__InfluenzaB__AGX18578
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaaaaacaagaccgccacgaauagucucacuauugaagucccguacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcuauaaauaagauuacuaaaaaccucaauucccugagcgaauuagaggucaagaaccugcagcgacucucgggggccauggacgagcuucauaaagaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaagaugcugggaccaagcgcgguugagauaggcaauggguguuucgaaacaaaacauaagugcaaccagaccugcuuagaucggaucgcagccggaacuuuugacgcuggugaguucucccugccuaccuuugauucucuaaauauuacagccgcaagccucaacgacgauggccuggacaaucacaccauccuuuuguauuacucaacugccgcuaguucccuggccgugacacucaugaucgcaauuuucgucguguauauggucagccgugauaacgugucuuguucaauaugccuguga

SEQ ID NO: 149255 - RNA, 1758 nt, Artificial Sequence
  derived and/or modified sequence opt3 from hemagglutinin__InfluenzaB__AGX18589
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacacugaaacacagauggcuaagcuguauggggauucuaaaccccagaaguuuaccagcuccgccaacggagugacgacccacuacgucucacaaauuggcgacuucccuaaucagacagaggauggugggcugccacagaguggacgcaucguuguggacuauaugguacaaaagagcggcaaaacuggcaccauuacauaccagagagggauccucuuaccccagaagguguggugcgcgucuggaagguccaaagucaucaaggguucacugccucuuauuggcgaagcagauuguuugcaugagaaauaugggggacugaacaagagcaaaccauacuacacuggcgagcacgccaaggcuauagguaauugccccaucugggugaagaccccgcuaaaacucgccaacgggacaaaguaucggccucccgcaaaacugcuuaaggaacgcggcuuuuucggagcuauugccggcuuucuggaagggggaugggaggguaugaucgcgggcuggcauggguacaccagucacggagcccacggcguugcaguggcugccgacuugaaaucuacucaggaggcuauaaauaagauuacgaagaaccucaauucccugagcgaauuagaggucaaaaaccugcagcgacucucgggugccauggaugagcuucauaaugaaauccuggaguuggacgaaaagguggacgaucuaagagcagacacaaucucuucccaaauugagcuggccguacuccugucaaacgaagggaucauuaauagugaggaugagcaccuucuggcuuuggaaaggaaacucaagaaaaugcugggcccaagcgcgguugagauaggaaacggcuguuucgaaaccaagcauaagugcaaucagacuugcuuagaccggaucgcagccgggaccuuugaugcuggagaguucucccugccuacauuugacucucuaaacauuaccgccgcaagccucaaugaugacggucuggauaaccacacuauccuuuuguauuacucaacagccgcuaguucccuggccgugacgcucaugaucgcaauuuucgucguguauauggucagccgugacaacgugucuuguucaauaugccuguga

SEQ ID NO: 149256 - RNA, 1758 nt, Artificial Sequence; identical to SEQ ID NO: 148530
  derived and/or modified sequence opt3 from hemagglutinin__InfluenzaB__AGX18600

SEQ ID NO: 149257 - RNA, 1758 nt, Artificial Sequence; identical to SEQ ID NO: 148530
  derived and/or modified sequence opt3 from hemagglutinin__InfluenzaB__AGX18611

SEQ ID NO: 149258 - RNA, 1758 nt, Artificial Sequence; identical to SEQ ID NO: 148530
  derived and/or modified sequence opt3 from hemagglutinin__InfluenzaB__AGX18622

SEQ ID NO: 149259 - RNA, 1758 nt, Artificial Sequence; identical to SEQ ID NO: 148530
  derived and/or modified sequence opt3 from hemagglutinin__InfluenzaB__AGX18633

SEQ ID NO: 149260 - RNA, 1758 nt, Artificial Sequence; identical to SEQ ID NO: 148530
  derived and/or modified sequence opt3 from hemagglutinin__InfluenzaB__AGX18644

SEQ ID NO: 149261 - RNA, 1758 nt, Artificial Sequence; identical to SEQ ID NO: 148530
  derived and/or modified sequence opt3 from hemagglutinin__InfluenzaB__AGX18655

SEQ ID NO: 149262 - RNA, 1758 nt, Artificial Sequence; identical to SEQ ID NO: 148530
  derived and/or modified sequence opt3 from hemagglutinin__InfluenzaB__AGX18666

SEQ ID NO: 149263 - RNA, 1758 nt, Artificial Sequence; identical to SEQ ID NO: 148530
  derived and/or modified sequence opt3 from hemagglutinin__InfluenzaB__AGX18677

SEQ ID NO: 149264 - RNA, 1758 nt, Artificial Sequence; identical to SEQ ID NO: 148530
  derived and/or modified sequence opt3 from hemagglutinin__InfluenzaB__AGX18688

SEQ ID NO: 149265 - RNA, 1758 nt, Artificial Sequence; identical to SEQ ID NO: 148530
  derived and/or modified sequence opt3 from hemagglutinin__InfluenzaB__AGX18699

SEQ ID NO: 149266 - RNA, 1758 nt, Artificial Sequence; identical to SEQ ID NO: 148530
  derived and/or modified sequence opt3 from hemagglutinin__InfluenzaB__AGX18710

SEQ ID NO: 149267 - RNA, 1758 nt, Artificial Sequence; identical to SEQ ID NO: 148530
  derived and/or modified sequence opt3 from hemagglutinin__InfluenzaB__AGX18721

SEQ ID NO: 149268 - RNA, 1758 nt, Artificial Sequence; identical to SEQ ID NO: 148530
  derived and/or modified sequence opt3 from hemagglutinin__InfluenzaB__AGX18732

SEQ ID NO: 149269 - RNA, 1758 nt, Artificial Sequence
  derived and/or modified sequence opt3 from hemagglutinin__InfluenzaB__AGX18743
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgaaucauaacguaauuaaugccgagaacgcaccagggggacccuauaaaaucggcacaucaggcagcugcccuaauguuacuaacgggaauggauucuuugccaccauggcuugggcagugccaaagaacgacaauaacaaaacagccaccaacagucucacgauugaagucccguacaucuguacugagggugaggaucagauaacaguguggggcuuccacuccgacaaugaaacccagauggcuaagcuguauggggauucuaaaccccagaaguuuacuagcuccgccaacggagugacaacccacuacgucucacaaauuggcgguuucccuaaucagacggaggacgggggacugccacagaguggccgcaucguuguggauuauaugguacaaaagagcggcaaaaccgggacaauuacuuaccagagaggaauccucuuaccccagaagguguggugcgcgucugguagguccaaagucaucaagggcucacugccucuuauuggggaagcagacuguuugcaugagaaauauggaggccugaacaagagcaaaccauacuacaccggugagcacgccaaggcuauagggaauugccccaucugggugaagacaccgcuaaaacucgccaacggcacuaaguaucggccucccgcaaaacugcuuaaggaacgcggauuuuucggcgcuauugccggguuucuggagggagguugggaaggcaugaucgcgggguggcauggauacaccagucacggcgcccacgguguugcaguggcugccgauuugaaaucuacacaggaggcuauaaauaagauuaccaagaaccucaauucccugagcgaauuagaggucaaaaaccugcagcgacucucgggggccauggacgagcuucauaaugaaauccuggaguuggaugaaaagguggacgaccuaagagcagauacuaucucuucccaaauugagcuggccguacuccugucaaacgaaggcaucauuaauagugaggacgagcaccuucuggcuuuggaaaggaaacucaagaaaaugcugggaccaagcgcgguugagauaggcaacggguguuucgaaacgaagcauaagugcaaucagacaugcuuagaucggaucgcagccggaaccuuugacgcuggugaguucucccugccuacuuuugauucucuaaacauuaccgccgcaagccucaacgacgauggccuggacaaucacacaauccuuuuguauuacucaaccgccgcuaguucccuggccgugacucucaugaucgcaauuuucgucguguauauggucagccgugauaacgugucuuguucaauaugccuguga

SEQ ID NO: 149270 - RNA, 1758 nt, Artificial Sequence; identical to SEQ ID NO: 148530
  derived and/or modified sequence opt3 from hemagglutinin__InfluenzaB__AGX18754

SEQ ID NO: 149271 - RNA, 1758 nt, Artificial Sequence; identical to SEQ ID NO: 148530
  derived and/or modified sequence opt3 from hemagglutinin__InfluenzaB__AGX18765

SEQ ID NO: 149272 - RNA, 1758 nt, Artificial Sequence; identical to SEQ ID NO: 148581
  derived and/or modified sequence opt3 from hemagglutinin__InfluenzaB__AGX18776

SEQ ID NO: 149273 - RNA, 1758 nt, Artificial Sequence; identical to SEQ ID NO: 148530
  derived and/or modified sequence opt3 from hemagglutinin__InfluenzaB__AGX18787

SEQ ID NO: 149274 - RNA, 1758 nt, Artificial Sequence; identical to SEQ ID NO: 148530
  derived and/or modified sequence opt3 from hemagglutinin__InfluenzaB__AGX18798

SEQ ID NO: 149275 - RNA, 1758 nt, Artificial Sequence
  derived and/or modified sequence opt3 from hemagglutinin__InfluenzaB__AGX18809
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacucugaaacucagauggcuaagcuguauggggauagcaaaccccagaaguuuacauccucagccaacggagugaccacgcacuacgucagucaaauuggcgguuucccuaaucagaccgaggacgggggacugccacagagcggccgcaucguuguggauuauaugaugcagaagucuggcaaaacagggacuauuaccuaccaaagaggaauccucuuaccccagaagguauggugcgcguccgguaggucaaaagugaucaagggcagccugccucuuauuggggaagcagacuguuugcaugagaaauauggaggccugaacaagaguaaaccauacuacacaggugagcacgccaaggcuauagggaauugccccaucugggucaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaucucacggcgcccacgguguggcaguugcugccgauuugaaauccacccaggaggcuauaaauaagauuacuaagaaccucaauagccugucggaauuagaggugaaaaaccugcagcgacucucuggggccauggacgagcuucauaaugaaauccuggaguuggaugaaaaggucgacgaccuaagagcagauacgaucuccucacaaauugagcuggccgugcuccugaguaacgaaggcaucauuaauagcgaggacgagcaccuucuggcuuuggaaaggaaacucaagaaaaugcugggaccauccgcgguagagauaggcaacggguguuucgaaacaaagcauaagugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccguuacacucaugaucgcaauuuucguggucuauauggugucucgugauaacgucucauguaguauaugccuguga

SEQ ID NO: 149276 - RNA, 1758 nt, Artificial Sequence; identical to SEQ ID NO: 149193
  derived and/or modified sequence opt3 from hemagglutinin__InfluenzaB__AGX18820

SEQ ID NO: 149277 - RNA, 1758 nt, Artificial Sequence; identical to SEQ ID NO: 148530
  derived and/or modified sequence opt3 from hemagglutinin__InfluenzaB__AGX18831

SEQ ID NO: 149278 - RNA, 1758 nt, Artificial Sequence; identical to SEQ ID NO: 148530
  derived and/or modified sequence opt3 from hemagglutinin__InfluenzaB__AGX18842

SEQ ID NO: 149279 - RNA, 1758 nt, Artificial Sequence; identical to SEQ ID NO: 148598
  derived and/or modified sequence opt3 from hemagglutinin__InfluenzaB__AGX18853

SEQ ID NO: 149280 - RNA, 1758 nt, Artificial Sequence
  derived and/or modified sequence opt3 from hemagglutinin__InfluenzaB__AGX18864
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccaugagguccgaccagugacuucuggcuguuuucccaucaugcacgaucguaccaagauaagacaacugccuaaccuucugagggguuaugaacauauccgguugucgaaucacaacguaauuaaugccgagaacgcaccagggggacccuacaaaaucggcacaucaggcagcugcccuaauguuacuaacgggaauggauucuuugccaccauggcuugggcagugccaaagaacgacaauaacaaaacagccaccaacagucucacgauugaagucccguauaucuguacugagggugaggaucagauaacaguguggggcuuccauuccgacaaugaagcucagauggccaagcuguacggggauucuaaaccccagaaguuuaccagcuccgcgaacggagugacuacacacuaugucucacaaauuggcgguuucccuaaucagaccgaggacgggggacugccacagaguggccgcaucguuguggauuacaugguacagaagaguggcaaaacggggaccauuacauaucaaagaggaauccucuuaccccagaagguguggugcgcaucugguagguccaaagucaucaagggcucacugccucuuauuggggaagccgacuguuugcacgagaaauacggaggccugaacaagagcaaaccauacuauacuggugagcaugcuaaggccauagggaauugccccaucugggugaagaccccgcuaaaacucgcaaacggcacaaaguaccggccucccgcuaaacugcuuaaggaacgcggauuuuucggcgccauugcgggguuucuggagggagguugggaaggcaugaucgccggguggcacggauauacuagccauggcgcacacgguguugcuguggccgcugauuugaaaucuacccaggaggccauaaauaagauuacaaagaaccucaauucccugagcgaauuagaggucaaaaaccugcagcgacucucgggggcaauggacgagcuucacaaugaaauccuggaguuggaugaaaagguggacgaccuaagagccgauaccaucucuucccaaauugagcuggcuguacuccugucaaacgaaggcaucauuaauagugaggacgagcaucuucuggcguuggaaaggaaacucaagaaaaugcugggaccaagcgcaguugagauaggcaacggguguuucgaaacuaagcacaagugcaaucagacgugcuuagaucggaucgccgcuggaacauuugacgccggugaguucucccugccuaccuuugauucucuaaacauuacugcagccagccucaacgacgauggccuggacaaucauaccauccuuuuguacuauucaacagcugccaguucccuggcagugacccucaugaucgcgauuuucgucguguacauggucagccgugauaacgugucuuguucaauaugccuguga

SEQ ID NO: 149281 - RNA, 1758 nt, Artificial Sequence
  derived and/or modified sequence opt3 from hemagglutinin__InfluenzaB__AGX18875
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaucgcaacggguucuuugccacaauggcuugggcagugccaaagaaugacaacaauaaaaccgccacgaacagucucacuauugaagucccguacaucuguacagagggagaggaucagauaaccgugugggguuuccacuccgacaacgaaauucagauggcuaagcuguauggcgauucuaaaccccagaaguuuacuagcuccgccaauggggugacaacccacuacgucucacaaaucggaggcuucccuaaccagacggaggacggugggcugccacagaguggaagaauuguuguggauuauaugguacaaaagagcggcaaaaccggcacaaucacuuaccagagggggauccucuuaccccagaagguguggugcgcgucuggacgguccaaagucauuaaggguucacugccucuuauaggcgaagcagacuguuugcaugagaaauaugggggacugaauaagagcaaaccauacuacaccggcgagcacgccaaggcuaucgguaacugccccauuugggugaagacaccgcuaaaacucgccaaugggacuaaguaucgcccucccgcaaaacugcuuaaggaacgaggcuuuuucggagcuaucgccggcuuucuggaagggggaugggaggguaugauagcgggcuggcauggguacaccagucacggagcccacggcguugcaguggcugccgauuugaaaucuacacaggaggcuauuaacaagaucaccaagaaucucaacucccugagcgaauuagaggucaaaaaucugcagagacucucgggugccaucgacgagcuucauaacgaaauucuggaguuggaugaaaagguggacgaccuaagggcagauacuaucucuucccaaauugagcuggccguacuccugucaaaugaagggauaaucaacagugaggacgagcaccuucuggcuuuggaacggaaacucaagaaaaugcugggcccaagcgcgguugagauuggaaauggcuguuucgaaacgaagcauaagugcaaccagacaugcuuagaucguaucgcagccgggaccuuugacgcuggagaguucucccugccuacuuuugauucucuaaauaucaccgccgcaagccucaacgacgauggucuggacaaccacacaauucuuuuguauuacucaaccgccgcuaguucccuggccgugacucucaugauagcaaucuucgucguguauauggucagccgcgauaaugugucuuguucaauuugccuguga

SEQ ID NO: 149282 - RNA, 1758 nt, Artificial Sequence
  derived and/or modified sequence opt3 from hemagglutinin__InfluenzaB__AGX18886
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaauucagauggcuaagcuguauggggauucuaaaccccagaaguuuacuagcuccgccaauggagugacaacccacuacgucucacaaaucggcgguuucccuaaccagacggaggacgggggacugccacagaguggccgcauuguuguggauuauaugguacaaaagagcggcaaaaccgggacaaucacuuaccagagaggaauccucuuaccccagaagguguggugcgcgucugguagguccaaagucauuaagggcucacugccucuuauaggggaagcagacuguuugcaugagaaauauggaggccugaauaagagcaaaccauacuacaccggugagcacgccaaggcuaucgggaacugccccauuugggugaagacaccgcuaaaacucgccaauggcacuaaguaucggccucccgcaaaacugcuuaaggaacgcggauuuuucggcgcuaucgccggguuucuggagggagguugggaaggcaugauagcgggguggcauggauacaccagucacggcgcccacgguguugcaguggcugccgauuugaaaucuacacaggaggcuauuaacaagaucaccaagaaucucaacucccugagcgaauuagaggucaaaaaucugcagcgacucucgggggccauggacgagcuucauaacgaaauccuggaguuggaugaaaagguggacgaccuaagagcagauacuauuucuucccaaaucgagcuggccguacuccugucaaaugaaggcauuauaaacagugaggacgagcaccuucuggcuuuggaaaggaaacucaagaaaaugcugggaccaagcgcgguugagaucggcaauggguguuucgaaacgaagcauaagugcaaccagacaugcuuagaucggauugcagccggaaccuuugacgcuggugaguucucccugccuacuuuugauucucuaaauaucaccgccgcaagccucaacgacaacggccuggauaaucacacaauccuuuuguauuacucaaccgccgcuaguucccuggccgugacucucauuauagcaaucuucgucguguauauggucagccgugacaacgugucuuguucaauuugccuguga

SEQ ID NO: 149283 - RNA, 1758 nt, Artificial Sequence; identical to SEQ ID NO: 149003
  derived and/or modified sequence opt3 from hemagglutinin__InfluenzaB__AGX18897

SEQ ID NO: 149284 - RNA, 1758 nt, Artificial Sequence; identical to SEQ ID NO: 148530
  derived and/or modified sequence opt3 from hemagglutinin__InfluenzaB__AGX18908

SEQ ID NO: 149285 - RNA, 1758 nt, Artificial Sequence; identical to SEQ ID NO: 148530
  derived and/or modified sequence opt3 from hemagglutinin__InfluenzaB__AGX18919

SEQ ID NO: 149286 - RNA, 1758 nt, Artificial Sequence
  derived and/or modified sequence opt3 from hemagglutinin__InfluenzaB__AGX18930
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcaucgaucggauugcagccggaacuuuugacgcuggugaguucuccuuaccuaccuuugauucucugaauaucacagccgcaagccuaaacgacgauggccucgacaaccacaccauccugcuuuauuacucaacugccgcuaguuccuuggccgugacacugaugauugcaauauucgucguguauauggucagccgugauaaugugucuuguucaaucugccucuga

SEQ ID NO: 149287 - RNA, 1758 nt, Artificial Sequence; identical to SEQ ID NO: 148530
  derived and/or modified sequence opt3 from hemagglutinin__InfluenzaB__AGX18941

SEQ ID NO: 149288 - RNA, 1758 nt, Artificial Sequence; identical to SEQ ID NO: 148530
  derived and/or modified sequence opt3 from hemagglutinin__InfluenzaB__AGX18952

SEQ ID NO: 149289 - RNA, 1758 nt, Artificial Sequence; identical to SEQ ID NO: 148530
  derived and/or modified sequence opt3 from hemagglutinin__InfluenzaB__AGX18963

SEQ ID NO: 149290 - RNA, 1758 nt, Artificial Sequence
  derived and/or modified sequence opt3 from hemagglutinin__InfluenzaB__AGX18974
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacagaaaagcggcaaaacagggacuauuaccuaccaaagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaagaagcucaaaaagaugcugggaccaagcgcgguugagauaggcaauggguguuucgaaacaaagcauaaaugcaaccagaccugcuuagauaggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgggauaaugugucuuguucaauaugccuguga

SEQ ID NO: 149291 - RNA, 1758 nt, Artificial Sequence; identical to SEQ ID NO: 148530
  derived and/or modified sequence opt3 from hemagglutinin__InfluenzaB__AGX18985

SEQ ID NO: 149292 - RNA, 1758 nt, Artificial Sequence
  derived and/or modified sequence opt3 from hemagglutinin__InfluenzaB__AGX18996
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauacuccuagcgcucgcguguccauccuccacgagguccgaccagugaccucuggcuguuuucccauuaugcaugaucguacaaagaucagacaacugccuaaccuucugagggguuacgaacacauacgguugucgacucauaauguaaucaacgccgagaaugcaccagggggacccuauaaaauuggcaccucaggcagcugcccuaacguuacaaaugggaacggauucuuugccaccauggcuugggcagugccaaagaaugacaacaauaaaacggccacuaacagucucacaaucgaagucccguacauuuguaccgagggugaggaucagaucacuguguggggcuuccacuccgacaacgggacacagauggcuaagcuguauggagauucuaaaccccagaaguuuaccagcuccgccaauggcgugacgacccacuacgucucacaaauagguggguucccuaaccagacagaagacggaggccugccacagaguggccgcauuguuguggauuauaugguacaaaagagcgggaaaacuggaaccaucacauaccagagagguauucucuuaccccagaagguguggugcgcgucuggcagguccaaagucaucaaggggucacugccucuuaucggagaggcagacuguuugcaugaaaaauauggcggucugaauaagagcaaaccauacuacacuggggagcacgccaaggcuauuggcaacugccccauaugggugaagaccccgcuaaaacucgccaauggaacaaaguaucggccucccgcaaaacugcuuaaggagcgcggcuuuuucggggcuaucgccggauuucuggaagguggcugggaggggaugauugcgggauggcauggcuacaccagucacggugcccacgggguugcaguggcugccgauuugaaaucuacucaggaagcuaucaacaagauaacgaagaaucucaacucccugagcgaguuagaagucaaaaaucugcagcgacucucgggcgccauggacgagcuucauaacgagauucuggaauuggaugagaagguggacgaccuaagagcagauacaaucucuucccaaaucgaacuggccguacuccugucaaaugagggaauuaucaacagugaagacgagcaccuucuggcuuuggagaggaaacucaagaaaaugcugggcccaagcgcgguugaaauugggaauggauguuucgagaccaagcauaagugcaaccagacuugcuuagaucggauagcagccgguaccuuugacgcuggcgaguucucccugccuacauuugauucucuaaauaucaccgccgcaagccucaacgacgaugggcuggacaaccacacuauucuuuuguauuacucaacagccgcuaguucccuggccgugacgcucaugaucgcaaucuucgucguguauauggucagccgugauaaugugucuuguucaauuugccuguga

SEQ ID NO: 149293 - RNA, 1758 nt, Artificial Sequence; identical to SEQ ID NO: 148530
  derived and/or modified sequence opt3 from hemagglutinin__InfluenzaB__AGX19007

SEQ ID NO: 149294 - RNA, 1758 nt, Artificial Sequence
  derived and/or modified sequence opt3 from hemagglutinin__InfluenzaB__AGX19018
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaacuuccuuagggguuacgaacacauccggcugucgacacauaauguaauuaacgccgagaaugcaccagggggacccuauaaaaucggcacuucaggcagcugcccuaacguuaccaaugggaacggauuuuucgccacaauggcuugggcagugccaaagaaugacaacaauaaaaccgccacgaacaguuugacuauugaagucccguacaucuguacagagggugaggaucagauaaccguguggggcuuucacuccgacucugaaacucagauggcuaagcucuauggggauagcaaaccccagaaguucacauccucagccaacggagugaccacgcacuacgucagucaaauuggcgguuuuccuaaucagaccgaggacgggggacugccacagagcggccgcaucguuguggauuauaugguacagaagucuggcaaaacagggacuauuaccuaccaaagaggaauccugcucccccagaagguguggugcgcguccgguaggucaaaagucaucaagggcagcuuaccucugauuggggaagcagacugucuucaugagaaauauggaggcuugaacaagaguaaaccauacuacacaggugagcacgccaaggcuauagggaauugccccaucugggugaagacuccgcugaaacuagccaacggcaccaaguaucggccucccgcaaaacuccugaaggaacgcggauucuuuggcgcuauugccggguuccuugagggagguugggaaggcaugaucgcgggguggcauggauacacaucucacggcgcccacgguguugcaguggcugccgaucugaaauccacccaggaggcuauaaauaagauuacuaagaacuugaauagccucucggaacuggaggucaaaaacuuacagcgacugucuggggccauggacgagcuccauaaugaaauccuugagcuggaugaaaagguggacgacuugagagcagauacgaucuccucacaaauugagcuagccguacugcucaguaacgaaggcaucauuaauagcgaggacgagcaucugcuugcucuggaaaggaaauugaagaaaaugcucggaccauccgcgguugagauaggcaacggguguuuugaaacaaagcacaagugcaaucagaccugccuggaucggaucgcagccggaacuuucgacgcuggugaguuuucuuuaccuaccuucgauagccugaacauuacagccgcaucacuaaaugacgauggccucgacaaccacaccauccugcuuuauuacaguacugccgcuuccagcuuggccgugacacugaugaucgcaauuuucgucguguauauggucucucgugauaacgugucauguaguauaugccucuga

SEQ ID NO: 149295 - RNA, 1758 nt, Artificial Sequence; identical to SEQ ID NO: 149193
  derived and/or modified sequence opt3 from hemagglutinin__InfluenzaB__AGX19029

SEQ ID NO: 149296 - RNA, 1758 nt, Artificial Sequence; identical to SEQ ID NO: 148530
  derived and/or modified sequence opt3 from hemagglutinin__InfluenzaB__AGX19040

SEQ ID NO: 149297 - RNA, 1758 nt, Artificial Sequence
  derived and/or modified sequence opt3 from hemagglutinin__InfluenzaB__AGX19051
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacacugagaaugccccagggggacccuauaaaaucggcaccucaggcagcugcccuaacguuacaaaugggaacggauucuuugcaaccauggccugggcugugccaaagaaugacaacaauaaaacggcaacuaacagucucacaauugaagucccguacaucuguaccgagggugaggaucagauaacuguguggggcuuccacuccgacucugaaacacagauggccaagcuguauggggauagcaaaccccagaaguuuaccuccucagcuaacggagugacgacccacuacgucagucaaauuggcgguuucccuaaucagacagaggacgggggacugccacagagcggccgcaucguuguggauuauaugguacagaagucuggcaaaacugggaccauuacauaccaaagaggaauccucuuaccccagaagguguggugcgccuccgguaggucaaaagucaucaagggcagccugccucuuauuggggaagcggacuguuugcaugagaaauauggaggccugaacaagaguaaaccauacuacacuggugagcacgcaaaggccauagggaauugccccaucugggugaagaccccgcuaaaacucgcuaacggcacaaaguaucggccucccgccaaacugcuuaaggaacgcggauuuuucggcgcaauugcuggguuucuggagggagguugggaaggcaugaucgccggguggcauggauacaccucucacggcgcgcacgguguugccguggcagcugauuugaaauccacucaggaggccauaaauaagauuacgaagaaccucaauagccugucggaauuagaggucaaaaaccugcagcgacucucuggggcuauggacgagcuucauaaugaaauccuggaguuggaugaaaagguggacgaccuaagagccgauacaaucuccucacaaauugagcuggcaguacuccugaguaacgaaggcaucauuaauagcgaggacgagcaccuucuggccuuggaaaggaaacucaagaaaaugcugggaccauccgcuguugagauaggcaacggguguuucgaaaccaagcauaagugcaaucagacuugcuuagaucggaucgcggcaggaaccuuugacgccggugaguucucucugccuacauuugauagccuaaacauuaccgcugccucacucaaugacgauggccuggacaaccacacuauccuuuuguauuacaguacagcagccuccagccuggcugugacgcucaugaucgccauuuucgucguguauauggucucucgugauaacgugucauguaguauaugccuguga

SEQ ID NO: 149298 - RNA, 1758 nt, Artificial Sequence
  derived and/or modified sequence opt3 from hemagglutinin__InfluenzaB__AGX19062
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaauuucaacucccucagcgaacuggaggucaaaaauuuacagcgacugucgggggccauggacgagcuccauaacgaaauccuugagcuggaugaaaagguggacgacuugagagcagauacgaucucuucccaaauugagcuagccguacugcucucaaaugaaggcaucauuaacagugaggacgagcaucugcuugcucuggaaaggaaauugaagaaaaugcucggaccaagcgcgguugagauaggcaauggguguuuugaaacaaagcacaagugcaaccagaccugccuggaucggaucgcagccggaacuuucgacgcuggugaguuuuccuuaccuaccuucgauucucugaauauuacagccgcaagccuaaacgacgauggccucgacaaccacaccauccugcuuuauuacucaacugccgcuaguuccuuggccgugacacugaugaucgcaauuuucgucguguauauggucagccgugauaaugugucuuguucaauaugccucuga

SEQ ID NO: 149299 - RNA, 1758 nt, Artificial Sequence; identical to SEQ ID NO: 148530
  derived and/or modified sequence opt3 from hemagglutinin__InfluenzaB__AGX19073

SEQ ID NO: 149300 - RNA, 1758 nt, Artificial Sequence
  derived and/or modified sequence opt3 from hemagglutinin__InfluenzaB__AGX19084
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacaucaaauugucgacacauaauguaauuaacgccgagaaugcaccagggggacccuauaagaucggcacuucaggcagcugcccuaacguuaccaaugggaacggauucuuugccacaauggcuugggcagugccgaaaaaugacaacaauaagaccgccacgaacagucucacuauugaagucccauacaucuguacagagggugaggaucagauaaccguguggggcuuccacuccgacaacgaaaaucagauggcuaaacuguauggggauucuaagccccagaaguuuacuagcuccgccaacggagugacaacccacuacgucucacaaauuggcgguuucccuaaucagacggaggacgggggacugccacagaguggccggaucguuguggauuauaugguacagaaaagcggcaagaccgggacaauuacuuaccaacgcggaauccucuuaccccagaaaguguggugcgcgucugguagauccaaggucaucaaaggcucacugccucuuauuggggaagcagacuguuugcaugagaaguauggaggccugaacaaaagcaagccauacuacaccggugagcacgccaaggcuauagggaauugccccaucugggugaaaacaccgcuaaagcucgccaacggcacuaaauauaggccucccgcaaagcugcuuaaagaacggggauuuuucggcgcuauugccggguuucuggagggagguugggaaggcaugaucgcgggguggcauggauacaccagucacggcgcccacgguguugcaguggcugccgauuugaagucuacacaggaggcuauaaauaagauuaccaaaaaccucaauucccugagcgaauuagaggucaagaaccugcagcgccucucgggggccauggacgagcuucauaaugaaauccuggaguuggaugaaaaaguggacgaccuacgagcagauacuaucucuucccaaauugagcuggccguacuccugucaaacgaaggcaucauuaauagugaggacgagcaccuucuggcuuuggaaagaaagcucaaaaagaugcugggaccaagcgcgguugagauaggcaacggguguuucgaaacgaagcauaaaugcaaucagacaugcuuagauaggaucgcagccggaaccuuugacgcuggugaguucucccugccuacuuuugauucucuaaacauuaccgccgcaagccucaacgacgauggccuggacaaucacacaauccuuuuguauuacucaaccgccgcuaguucccuggccgugacucucaugaucgcaauuuucgucguguauauggucagccgggauaacgugucuuguucaauaugccuguga

SEQ ID NO: 149301 - RNA, 1758 nt, Artificial Sequence; identical to SEQ ID NO: 148530
  derived and/or modified sequence opt3 from hemagglutinin__InfluenzaB__AGX19095

SEQ ID NO: 149302 - RNA, 1758 nt, Artificial Sequence; identical to SEQ ID NO: 149193
  derived and/or modified sequence opt3 from hemagglutinin__InfluenzaB__AGX19106

SEQ ID NO: 149303 - RNA, 1758 nt, Artificial Sequence; identical to SEQ ID NO: 148530
  derived and/or modified sequence opt3 from hemagglutinin__InfluenzaB__AGX19117

SEQ ID NO: 149304 - RNA, 1758 nt, Artificial Sequence
  derived and/or modified sequence opt3 from hemagglutinin__InfluenzaB__AGX19128
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauacuccuagcgcucgcguguccauccuccacgagguccgaccagugaccucuggcuguuuucccauuaugcaugaucguacaaagaucagacaacugccuaaccuucugagggguuacgaacacauacgguugucgacucauaauguaaucaacgccgagaaugcaccagggggacccuauaaaauuggcaccucaggcagcugcccuaacguuacaaaugggaacggauucuuugccaccauggcuugggcagugccaaagaaugacaacaauaaaacggccacuaacagucucacaaucgaagucccguacauuuguaccgagggugaggaucagaucacuguguggggcuuccacuccgacucugaaacacagauggcuaagcuguauggggauagcaaaccccagaaguuuaccuccucagccaacggagugacgacccacuacgucagucaaauaggcgguuucccuaaucagacagaggacgggggacugccacagagcggccgcauuguuguggauuauaugguacagaagucuggcaaaacugggaccaucacauaccaaagagguauucucuuaccccagaagguguggugcgcguccggaaggucaaaagucaucaagggcagccugccucuuaucggggaagcagacuguuugcaugagaaauauggaggccugaacaagaguaaaccauacuacacuggugagcacgccaaggcuauugggaauugccccauaugggugaagaccccgcuaaaacucgccaacggcacaaaguaucggccucccgcaaaacugcuuaaggaacgcggauuuuucggcgcuaucgccggguuucuggagggagguugggaaggcaugauugcgggguggcauggauacaccucucacggcgcccacgguguugcaguggcugccgauuugaaauccacucaggaggcuaucaauaagauaacgaagaaccucaauagccugucggaauuagaggucaaaaaccugcagcgacucucuggggccauggacgagcuucauaaugaaauucuggaguuggaugaaaagguggacgaccuaagagcagauacaaucuccucacaaaucgagcuggccguacuccugaguaacgaaggcauuaucaauagcgaggacgagcaccuucuggcuuuggaaaggaaacucaagaaaaugcugggaccauccgcgguugagauuggcaacggguguuucgaaaccaagcauaagugcaaucagacuugcuuagaucggauagcagccggaaccuuugacgcuggugaguucucucugccuacauuugauagccuaaacaucaccgccgcaucacucaaugacgauggccuggacaaccacacuauucuuuuguauuacaguacagccgcuuccagccuggccgugacgcucaugaucgcaaucuucgucguguauauggucucucgugauaacgugucauguaguauuugccuguga

SEQ ID NO: 149305 - RNA, 1758 nt, Artificial Sequence; identical to SEQ ID NO: 148530
  derived and/or modified sequence opt3 from hemagglutinin__InfluenzaB__AGX19139

SEQ ID NO: 149306 - RNA, 1758 nt, Artificial Sequence; identical to SEQ ID NO: 149003
  derived and/or modified sequence opt3 from hemagglutinin__InfluenzaB__AGX19150

SEQ ID NO: 149307 - RNA, 1758 nt, Artificial Sequence; identical to SEQ ID NO: 148530
  derived and/or modified sequence opt3 from hemagglutinin__InfluenzaB__AGX19161

SEQ ID NO: 149308 - RNA, 1758 nt, Artificial Sequence; identical to SEQ ID NO: 149003
  derived and/or modified sequence opt3 from hemagglutinin__InfluenzaB__AGX19172

SEQ ID NO: 149309 - RNA, 1758 nt, Artificial Sequence
  derived and/or modified sequence opt3 from hemagglutinin__InfluenzaB__AGX19183
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacacugaaacacagauggcuaagcuguauggggauucuaaaccccagaaguuuaccagcuccgccaacggagugacgacccacuacgucucacaaauuggcgguuucccuaaucagacagaggacgggggacugccacagaguggccgcaucguuguggauuauaugguacaaaagagcggcaaaacugggaccauuacauaccagagaggaauccucuuaccccagaagguguggugcgcgucugguagguccaaagucaucaagggcucacugccucuuauuggggaagcagacuguuugcaugagaaauauggaggccugaacaagagcaaaccauacuacacuggugagcacgccaaggcuauagggaauugccccaucugggugaagaccccgcuaaaacucgccaacggcacaaaguaucggccucccgcaaaacugcuuaaggaacgcggauuuuucggcgcuauugccggguuucuggagggagguugggaaggcaugaucgcgggguggcauggauacaccagucacggcgcccacgguguugcaguggcugccgauuugaaaucuacucaggaggcuauaaauaagauuacgaagaaccucaauucccugagcgaauuagaggucaaaaaccugcagcgacucucgggggccauggacgagcuucauaaugaaauccuggaguuggaugaaaagguggacgaccuaagagcagauacaaucucuucccaaauugagcuggccguacuccugucaaacgaaggcaucauuaauagugaggacgagcaccuucuggcuuuggaaaggaaacucaagaaaaugcugggaccaagcgcgguugagauaggcaacggguguuucgaaaccaagcauaagugcaaucagacuugcuuagaucggaucgcagccggaaccuuugacgcuggugaguucucccugccuacauuugauucucuaaacauuaccgccgcaagccucaaugacgauggccuggacaaccacacuauccuuuuguauuacucaacagccgcuaguucccuggccgugacgcucaugaucgcaauuuucgucguguauauggucagccgugauaacgugucuuguucaauaugccuguga

SEQ ID NO: 149310 - RNA, 1758 nt, Artificial Sequence; identical to SEQ ID NO: 148530
  derived and/or modified sequence opt3 from hemagglutinin__InfluenzaB__AGX19194

SEQ ID NO: 149311 - RNA, 1758 nt, Artificial Sequence
  derived and/or modified sequence opt3 from hemagglutinin__InfluenzaB__AGX19205
augaaggccaucauugugcugcucauggucguuaccagcaacgcugacagagugugcacaggcauaacuuccucuaauucaccccacguagugaaaacggcaacccagggggaggucaacgugacaggaguuaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaauauuccuagcgcucgcgucuccauccuccacgaggugcgaccaguaacuucuggcuguuuucccauuaugcaugaucguaccaagaucagacaacugccuaaccuucugagggguuacgaacacauacgguugucgacacauaauguuaucaacgccgagaaugcaccagggggacccuauaaaauuggcacuucaggcagcugcccuaacgugaccaaugggaacggauucuuugccacaauggcuugggcagucccaaagaaugacaacaauaaaaccgccacgaacagucucacuaucgaagugccguacauuuguacagagggugaggaucagaucaccguguggggcuuccacuccgacaacgaaacucagauggcuaagcuguauggggauucuaaaccccagaaguuuacaagcuccgccaauggagucaccacgcacuacguuucacaaauaggcgguuucccuaaccagaccgaggacgggggacugccacagaguggccgcauugugguagauuauauggugcaaaagagcggcaaaacagggacuaucaccuaccagagagguauucucuuaccccagaaggucuggugcgcgucuggaagguccaaagugaucaagggcucacugccucuuaucggggaagcagacuguuugcaugagaaauauggaggccugaauaagagcaaaccauacuacacaggugagcacgccaaggcuauugggaacugccccauauggguuaagacuccgcuaaaacucgccaauggcaccaaguaucggccucccgcaaaacugcuuaaggaacgcggauuuuucggcgcuaucgccggguuucuggagggagguugggaaggcaugauugcgggguggcauggauacacaagucacggcgcccacgguguggcagucgcugccgauuugaaaucuacccaggaggcuaucaacaagauaacuaagaaucucaacucccugagcgaauuagaggugaaaaaucugcagcgacucucgggggccauggacgagcuucauaacgaaauucuggaguuggaugaaaagguagacgaccuaagagcagauacgaucucuucccaaaucgagcuggccguucuccugucaaaugaaggcauuaucaacagugaggacgagcaccuucuggcuuuggaaaggaaacucaagaaaaugcugggaccaagcgcgguggagauuggcaauggguguuucgaaacaaagcauaagugcaaccagaccugcuuagaucggauagcagccggaacuuuugacgcuggugaguucucccugccuaccuuugauucucuaaauaucacagccgcaagccucaacgacgauggccuggacaaccacaccauucuuuuguauuacucaacugccgcuaguucccuggccgucacacucaugaucgcaaucuucguggucuauauggugagccgugauaauguuucuuguucaauuugccuguga

SEQ ID NO: 149312 - RNA, 1758 nt, Artificial Sequence
  derived and/or modified sequence opt3 from hemagglutinin__InfluenzaB__AGX19216
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaacccgggacaauuacuuaccagagaggaauccucuuaccucagaagguguggugcgcgucugguagguccaaagucaucaagggcucacugccacuuauuggggaagcagacuguuugcaugagaaauauggaggccugaauaagagcaaacccuacuacaccggugagcacgccaaggcuauagggaacugcccgaucugggugaagacaccucuaaaacucgccaauggcacuaaguaucggcccccagcaaaacugcuuaaggaacgcggauuuuucggcgcuauugccggguuucuggagggagguugggaaggcaugaucgcgggguggcauggauacaccagucacggcgcccacgguguugcaguggcugccgauuugaaaucuacacaggaggcuauaaacaagauuaccaagaaucucaacucccugagcgaauuagaggucaaaaaucugcagcgacucucgggggccauggacgagcuucauaacgaaauccuggaguuggaugaaaagguggacgaccuaagagcagauacuaucucuucccaaauugagcuggccguacuccugucaaaugaaggcaucauuaacagugaggacgagcaccuucuggcuuuggaaaggaaacucaagaaaaugcugggaccuagcgcgguugagauaggcaauggguguuucgaaacgaagcauaagugcaaccagacaugcuuagaucggaucgcagccggaaccuuugacgcuggugaguucucccugcccacuuuugauucucuaaauauuaccgccgcaagccucaacgacgauggccuggacaaccacacaauccuuuuguauuacucaaccgccgcuaguucccuggccgugacucucaugaucgcaauuuucgucguguauauggucagccgugauaaugugucuuguucaauaugccuguga

SEQ ID NO: 149313 - RNA, 1758 nt, Artificial Sequence
  derived and/or modified sequence opt3 from hemagglutinin__InfluenzaB__AGX19227
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgcaaugcuuaaacuguaccgaucuggacguugcgcuagggcggcccaaaugcacgggaaauaucccuagcgcucgcguguccauucuccacgagguccgaccagugacuucuggcuguuuucccaucaugcaugaucguaccaagauaagacagcugccuaaccuucugagggguuacgaacacauccgguugucgacacauaauguaauuaacgccgagaaugcaccagggggacccuauaagaucggcacuucaggcagcugcccuaacguuaccaaugggaacggauucuuugccacaauggcuugggcagugccaaaaagugacaauaacaagaccgccacuaauucccucacgauugaagucccguacaucuguacagagggugaggaucagauaaccguguggggcuuccacucugacaacgaaacucagauggcuaaacuguauggggauagcaagccccaaaaauuuacauccucagccaacggagugaccacgcacuacgucagucagauuggcgguuucccuaaucagaccgaggacgggggacugccacagagcggccgcaucguuguggauuauaugguacaaaagucuggcaagacagggacuauuaccuaccagagaggaauccucuuaccccagaaaguguggugcgcguccgguaggucaaaggucaucaaaggcagccugccucuuauuggggaagcagacuguuugcaugagaaguauggaggccugaacaaaaguaagccauacuacacaggugagcacgccaaagcuauagggaauugccccaucugggugaagacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaucucacggcgcccacgguguugcaguggcugccgauuugaaguccacccaggaggcuauaaauaaaauuacuaagaaccucaauagccugucggaauuagaggucaagaaccugcaacgacucucuggggccauggacgagcuucauaaugaaauccuggaguuggaugaaaaaguggacgaccuaagagcagauacgaucuccucacagauugagcuggccguacuccugaguaacgaaggcaucauuaauagcgaggacgagcaccuucuggcuuuggaaaggaagcucaaaaagaugcugggaccauccgcgguugagauaggcaacggguguuucgaaacaaaacauaagugcaaucagaccugcuuagaucggaucgcagccggaacuuuugacgcuggugaguucucucugccuaccuuugauagccuaaacauuacagccgcaucacucaaugacgauggccuggacaaccacaccauccuuuuguauuacaguacugccgcuuccagccuggccgugacacucaugaucgcaauuuucgucguguauauggucucucgugauaacgugucauguaguauaugccuguga

SEQ ID NO: 149314 - RNA, 1758 nt, Artificial Sequence
  derived and/or modified sequence opt3 from hemagglutinin__InfluenzaB__AGX19238
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaaaaacaagaccgccacgaauagucucacuauugaagucccguacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcuauaaauaagauuacuaaaaaccucaauucccugagcgaauuagaggucaagaaccugcagcgacucucgggggccauggacgagcuucauaaugaaauccuggaguuggaugaaaaaguggacgaccuaagagcagauacgaucucuucccaaauugagcuggccguacuccugucaaacgaaggcaucauuaauagugaggacgagcaccuucuggcuuuggaaaggaagcucaaaaagaugcugggaccaagcgcgguugagauaggcaacggguguuucgaaacaaagcauaaaugcaaucagaccugcuuagaucggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgugauaacgugucuuguucaauaugccuguga

SEQ ID NO: 149315 - RNA, 1758 nt, Artificial Sequence; identical to SEQ ID NO: 149314
  derived and/or modified sequence opt3 from hemagglutinin__InfluenzaB__AGX19249

SEQ ID NO: 149316 - RNA, 1758 nt, Artificial Sequence; identical to SEQ ID NO: 148530
  derived and/or modified sequence opt3 from hemagglutinin__InfluenzaB__AGX19260

SEQ ID NO: 149317 - RNA, 1758 nt, Artificial Sequence; identical to SEQ ID NO: 148530
  derived and/or modified sequence opt3 from hemagglutinin__InfluenzaB__AGX19271

SEQ ID NO: 149318 - RNA, 1758 nt, Artificial Sequence
  derived and/or modified sequence opt3 from hemagglutinin__InfluenzaB__AGX19282
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcacaucugguagguccaaagucaucaagggcucacugccucuuauuggggaagcggacuguuugcaugagaaauauggaggccugaauaagagcaaaccauacuacacuggugagcacgcaaaggccauagggaacugccccaucugggugaagaccccgcuaaaacucgcuaauggcacaaaguaucggccucccgccaaacugcuuaaggaacgcggauuuuucggcgcaauugcuggguuucuggagggagguugggaaggcaugaucgccggguggcauggauacaccagucacggcgcgcacgguguugccguggcagcugauuugaaaucuacucaggaggccauaaacaagauuacgaagaaucucaacucccugagcgaauuagaggucaaaaaucugcagcgacucucgggggcuauggacgagcuucauaacgaaauccuggaguuggaugaaaagguggacgaccuaagagccgauacaaucucuucccaaauugagcuggcaguacuccugucaaaugaaggcaucauuaacagugaggacgagcaccuucuggccuuggaaaggaaacucaagaaaaugcugggaccaagcgcuguugagauaggcaauggguguuucgaaaccaagcauaagugcaaccagacuugcuuagaucggaucgcggcaggaaccuuugacgccggugaguucucccugccuacauuugauucucuaaauauuaccgcugccagccucaacgacgauggccuggacaaccacacuauccuuuuguauuacucaacagcagccaguucccuggcugugacgcucaugaucgccauuuucgucguguauauggucagccgugauaaugugucuuguucaauaugccuguga

SEQ ID NO: 149319 - RNA, 1758 nt, Artificial Sequence
  derived and/or modified sequence opt3 from hemagglutinin__InfluenzaB__AGX19304
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccauuaacagucucacgaucgaagucccguacauauguacugagggugaggaucagauuacaguguggggcuuccacuccgacaacgaaacccagauggcuaagcuguauggggauucuaaaccccagaaguuuacuagcuccgccaauggagugacaacccacuacgucucacaaaucggcgguuucccuaaccagacggaggacgggggacugccacagaguggccgcauuguuguggauuauaugguacaaaagagcggcaaaaccgggacaaucacuuaccagagaggaauccucuuaccccagaagguguggugcgcgucugguagguccaaagucauuaagggcucacugccucuuauaggggaagcagacuguuugcaugagaaauauggaggccugaauaagagcaaaccauacuacaccggugagcacgccaaggcuaucgggaacugccccauuugggugaagacaccgcuaaaacucgccaauggcacuaaguaucggccucccgcaaaacugcuuaaggaacgcggauuuuucggcgcuaucgccggguuucuggagggagguugggaaggcaugauagcgggguggcauggauacaccagucacggcgcccacgguguugcaguggcugccgauuugaaaucuacacaggaggcuauuaacaagaucaccaagaaucucaacucccugagcgaauuagaggucaaaaaucugcagcgacucucgggggccauggacgagcuucauaacgaaauccuggaguuggaugaaaagguggacgaccuaagagcagauacuauuucuucccaaaucgagcuggccguacuccugucaaaugaaggcauuauaaacagugaggacgagcaccuucuggcuuuggaaaggaaacucaagaaaaugcugggaccaagcgcgguugagaucggcaauggguguuucgaaacgaagcauaagugcaaccagacaugcuuagaucggauugcagccggaaccuuugacgcuggugaguucucccugccuacuuuugauucucuaaauaucaccgccgcaagccucaacgacgauggccuggacaaccacacaauccuuuuguauuacucaaccgccgcuaguucccuggccgugacucucaugauugcaauauucgucguguauauggucagccgugauaaugugucuuguucaaucugccuguga

SEQ ID NO: 149320 - RNA, 1758 nt, Artificial Sequence; identical to SEQ ID NO: 149319
  derived and/or modified sequence opt3 from hemagglutinin__InfluenzaB__AGX19315

SEQ ID NO: 149321 - RNA, 1758 nt, Artificial Sequence; identical to SEQ ID NO: 149318
  derived and/or modified sequence opt3 from hemagglutinin__InfluenzaB__AGX19326

SEQ ID NO: 149322 - RNA, 1758 nt, Artificial Sequence; identical to SEQ ID NO: 149318
  derived and/or modified sequence opt3 from hemagglutinin__InfluenzaB__AGX19337

SEQ ID NO: 149323 - RNA, 1758 nt, Artificial Sequence
  derived and/or modified sequence opt3 from hemagglutinin__InfluenzaB__AGX19348
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaagcucagauggccaagcuguauggggauucuaaaccccagaaguuuacuagcuccgcgaauggagugacaacccacuacgucucacaaauuggcgguuucccuaaccagacggaggacgggggacugccacagaguggccgcaucguuguggauuauaugguacaaaagagcggcaaaaccgggacaauuacuuaccagagaggaauccucuuaccccagaagguguggugcaccucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 149324 - RNA, 1758 nt, Artificial Sequence; identical to SEQ ID NO: 149318
  derived and/or modified sequence opt3 from hemagglutinin__InfluenzaB__AGX19359

SEQ ID NO: 149325 - RNA, 1755 nt, Artificial Sequence; identical to SEQ ID NO: 148747
  derived and/or modified sequence opt3 from hemagglutinin__InfluenzaB__AGX19370

SEQ ID NO: 149326 - RNA, 1758 nt, Artificial Sequence; identical to SEQ ID NO: 148581
  derived and/or modified sequence opt3 from hemagglutinin__InfluenzaB__AGX19381

SEQ ID NO: 149327 - RNA, 1758 nt, Artificial Sequence; identical to SEQ ID NO: 149318
  derived and/or modified sequence opt3 from hemagglutinin__InfluenzaB__AGX19392

SEQ ID NO: 149328 - RNA, 1758 nt, Artificial Sequence; identical to SEQ ID NO: 149318
  derived and/or modified sequence opt3 from hemagglutinin__InfluenzaB__AGX19403

SEQ ID NO: 149329 - RNA, 1758 nt, Artificial Sequence; identical to SEQ ID NO: 149005
  derived and/or modified sequence opt3 from hemagglutinin__InfluenzaB__AGX19414

SEQ ID NO: 149330 - RNA, 1755 nt, Artificial Sequence
  derived and/or modified sequence opt3 from hemagglutinin__InfluenzaB__AGX19425
augaagaccaucauugugcugcucauggucguuacaagcaacgccgacagaauaugcacuggcaucacguccucuaauucaccccacgugguaaaaaccgcuacacagggggaggugaacgucacuggagugauuccucuuaccacaaccccaacuaagaguuacuucgcaaaucugaaagguacaaggacccggggcaaguuguguccggauugcuuaaacuguacggaccuggauguugcccuagggcgccccaugugcgugggaacuaccccuagcgcgaaagcuagcauccuccaugaaguccgaccagugacaucuggcuguuuucccauuaugcacgaccguacuaagaucagacaacugccuaaucuucugagggguuaugagaacauacgguugucgacccagaauguaaucgaugccgaaaaggcaccagggggacccuaccgccucggcacaucaggcagcugcccuaacgccaccaguaaauccggguucuuugcuacgauggcaugggccguuccaaaggacaauaacaaaaaugcuacuaacccgcugacaguggagguccccuauauuuguaccgaaggagaggaucagaucacugugugggguuuccauucugacaauaagacacagaugagaaaccuguacggcgauagcaauccucaaaaauuuaccuccucagccaacggggugacgacccacuaugucagucagauuggauccuucccagaccagacagaggauggcggucucccccagucugggaggaucguuguggacuacaugaugcaaaagccuggaaagacuggcaccauaguauaucagcggggcguguuacugccacagcgcgucuggugcgcguccgggcgaucaaaagugauuaagggagcacuucccuugaucggugaagccgauugucugcaugagaaauacggcgggcuaaacaagagcaaaccguacuauacaggagaacacgcuaaggccauuggcaauugcccuaucuggguuaaaacuccccucaagcuggcaaacgguaccaaguacagaccuccagcuaaacuucugaaggagaggggguuuuucggcgccaucgcgggauuuuuggagggcgggugggaaggaaugauugccgguuggcacggcuauacaagucauggggcacacggaguggcugucgccgcugaccucaaaucuacccaggaggccauaaauaagaucacuaaaaacuuaaauucccugagcgaacuggaggugaagaaccuccaacggcuuucgggcgcaauggacgaacugcauaaugagauuuuggagcuagaugaaaagguagacgaucugcgugccgacacgaucucuucccagauagagcucgcuguucugcuuucaaacgaagguauuaucaauagugaggaugaacaccuguuggcgcucgagcgcaaacugaagaaaauguuagggcccagcgcaguggagaucggcaacggauguuucgaaacaaagcacaaaugcaaucagaccugccuggacagaauugccgcuggcacuuuuaacgccggggaguucucccuaccaaccuuugauucucucaauaucacagcagccagccugaacgacgauggacuugacaaucauaccauuuugcuguacuauucaacugcugccaguucccucgcagucacacugaugcuugcgauauucaucguguacauggucagcagggauaacgugucuuguucaauuugccuguga

SEQ ID NO: 149331 - RNA, 1758 nt, Artificial Sequence; identical to SEQ ID NO: 148530
  derived and/or modified sequence opt3 from hemagglutinin__InfluenzaB__AGX19436

SEQ ID NO: 149332 - RNA, 1758 nt, Artificial Sequence; identical to SEQ ID NO: 149193
  derived and/or modified sequence opt3 from hemagglutinin__InfluenzaB__AGX19447

SEQ ID NO: 149333 - RNA, 1755 nt, Artificial Sequence; identical to SEQ ID NO: 149072
  derived and/or modified sequence opt3 from hemagglutinin__InfluenzaB__AGX19458

SEQ ID NO: 149334 - RNA, 1755 nt, Artificial Sequence; identical to SEQ ID NO: 149072
  derived and/or modified sequence opt3 from hemagglutinin__InfluenzaB__AGX19469

SEQ ID NO: 149335 - RNA, 1758 nt, Artificial Sequence; identical to SEQ ID NO: 149005
  derived and/or modified sequence opt3 from hemagglutinin__InfluenzaB__AGX19480

SEQ ID NO: 149336 - RNA, 1758 nt, Artificial Sequence; identical to SEQ ID NO: 148598
  derived and/or modified sequence opt3 from hemagglutinin__InfluenzaB__AGX19491

SEQ ID NO: 149337 - RNA, 1758 nt, Artificial Sequence
  derived and/or modified sequence opt3 from hemagglutinin__InfluenzaB__AGX19502
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccaaagaacgacaagaauaaaaccgccacgaacccgcucacuaucgaagugcccuacauauguacagagggugaggaucagauuaccgucuggggcuuccacagugacuccgaaacucagauggcuaagcuguauggggauucuaagccucagaaauuuacaagcuccgccaauggagugaccacgcacuacgugucacaaaucggcgguuucccaaaccagaccgaggacgggggacugccccagaguggccgcauugucguugauuauauggugcagaaaagcggcaaaacagggacuaucaccuaccaaagaggaauccucuuaccucagaagguauggugcgcgucugguagguccaaagugauuaagggcucacugccacuuauaggggaagcagacuguuugcaugagaaauauggaggccugaacaagagcaagcccuacuacacaggugagcacgccaaagcuaucgggaauugcccgauuugggucaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgacucucgggggccauggacgagcuucauaaugaaauccuggaguuggaugaaaaggucgacgaccuaagagcagauacgauuucuucccaaaucgagcuggccgugcuccugucaaacgaaggcauuauaaauagugaggacgagcaccuucuggcuuuggaaaggaaacucaagaagaugcugggaccuagcgcgguagagaucggcaacggguguuucgaaacaaaacauaagugcaaucagaccugcuuagaucggauugcagccggaacuuuugacgcuggugaguucucccugcccaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgugauaaugucucuuguucaaucugccuguga

SEQ ID NO: 149338 - RNA, 1758 nt, Artificial Sequence
  derived and/or modified sequence opt3 from hemagglutinin__InfluenzaB__AGX19513
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacaucucccaaauuggcgguuucccaaaccagaccgaggacgggggacugccccagucaggccgcaucguggucgauuauaugguucagaagaguggcaaaacagggacuaucaccuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacacaggugagcacgccaaagcuauugggaacugcccgaucugggugaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacggugucgcaguggcugccgauuugaagaguacccaggaggcuaucaacaaaaucacuaagaaucucaacucucuguccgaauuagagguuaaaaaucugcagcgacucagcggggccauggacgagcuucauaacgaaauucuggaguuggaugaaaagguggacgaccuaagagcagauacgaucucgucucaaauugagcuggccguccuccuguccaaugaaggcauaaucaacucagaggacgagcaccuucuggcuuuggaaaggaaacucaagaagaugcugggaccuagugcgguggagauuggcaauggguguuucgaaacaaaacauaagugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgugauaacgugagcuguucuauuugccuguga

SEQ ID NO: 149339 - RNA, 1758 nt, Artificial Sequence; identical to SEQ ID NO: 149338
  derived and/or modified sequence opt3 from hemagglutinin__InfluenzaB__AGX19524

SEQ ID NO: 149340 - RNA, 1758 nt, Artificial Sequence
  derived and/or modified sequence opt3 from hemagglutinin__InfluenzaB__AGX19535
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacgaugaaacucagauggcuaagcuguauggggacucuaaaccccagaaguuuacaagcuccgccaacggagugaccacgcacuacgucucacaaauuggcgguuucccuaaucagaccgaggaugggggacugccacagaguggccgcaucguuguggacuauaugguacaaaagagcggcaaaacagggacuauuaccuaccagagaggaauccucuuaccccagaagguguggugcgcgucugguagguccaaagucaucaagggcucacugccucuuauuggggaagcagauuguuugcaugagaaauauggaggccugaacaagagcaaaccauacuacacaggugagcacgccaaggcuauagggaauugccccaucugggugaagacuccgcuaaaacucgccaacggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgacuugaaaucuacccaggaggcuauaaauaagauuacuaagaaccucaauucccugagcgaauuagaggucaaaaaccugcagcgacucucgggggccauggaugagcuucauaaugaaauccuggaguuggacgaaaagguggacgaucuaagagcagacacgaucucuucccaaauugagcuggccguacuccugucaaacgaaggcaucauuaauagugaggaugagcaccuucuggcuuuggaaaggaaacucaagaaaaugcugggaccaagcgcgguugagauaggcaacggguguuucgaaacaaagcauaagugcaaucagaccugcuuagaccggaucgcagccggaacuuuugaugcuggugaguucucccugccuaccuuugacucucuaaacauuacagccgcaagccucaaugaugacggccuggauaaccacaccauccuuuuguauuacucaacugccgcuaguucccuggccgugacacucaugaucgcaauuuucgucguguauauggucagccgugacaacgugucuuguucaauaugccuguga

SEQ ID NO: 149341 - RNA, 1758 nt, Artificial Sequence
  derived and/or modified sequence opt3 from hemagglutinin__InfluenzaB__AGX19546
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaaggaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcgcgucugguagguccaaggucaucaaaggcucacugccucuuauuggggaagcagacuguuugcaugagaaguauggaggccugaacaaaagcaagccauacuacacaggugagcacgccaaggcuauagggaauugccccaucugggugaaaacuccgcuaaagcucgccaacggcaccaaauaucggccucccgcaaagcugcuuaaagaacgcggauuuuucggcgcuauugccggguuucuggagggagguugggaaggcaugaucgcgggguggcauggauacacaagucacggcgcccacgguguugcaguggcugccgauuugaagucuacccaggaggcuauaaauaagauuacuaaaaaccucaauucccugagcgaauuagaggucaagaaccugcagcgacucucgggggccauggacgagcuucauaaugaaauccuggaguuggaugaaaaaguggacgaccuaagagcagauacgaucucuucccaaauugagcuggccguacuccugucaaacgaaggcaucauuaauagugaggacgagcaccuucuggcuuuggaaaggaagcucaaaaagaugcugggaccaagcgcgguugagauaggcaacggguguuucgaaacaaagcauaaaugcaaucagaccugcuuagaucggaucgcagccggaacuuuugacgcuggugaguucucccugccuaccuuugauucucuaaacauuacagccgcaagccucaaugacgauggccuggacaaccacaccauccuuuuguauuacucaacugccgcuaguucccuggccgugacacucaugaucgcaauuuucgucguguauauggucagccgugauaacgugucuuguucaauaugccuguga

SEQ ID NO: 149342 - RNA, 1758 nt, Artificial Sequence
  derived and/or modified sequence opt3 from hemagglutinin__InfluenzaB__AGX19557
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagguggcgaggaucagauaaccguguggggguuccacuccgacaacgagacucagauggcuaagcuguauggagauucuaaaccccagaaguuuacaagcuccgccaauggcgugaccacgcacuacgucucacaaauugguggguucccuaaccagaccgaagacggaggccugccacagaguggccgcaucguuguggauuauaugguacaaaagagcgggaaaacaggaacuauuaccuaccagagagguauccucuuaccccagaagguguggugcgcgucuggcagguccaaagucaucaaggggucacugccucuuauuggagaggcagacuguuugcaugaaaaauauggcggucugaauaagagcaaaccauacuacacaggggagcacgccaaggcuauaggcaacugccccaucugggugaagacuccgcuaaaacucgccaauggaaccaaguaucggccucccgcaaaacugcuuaaggagcgcggcuuuuucggggcuauugccggauuucuggaagguggcugggaggggaugaucgcgggauggcauggcuacacaagucacggugcccacgggguugcaguggcugccgauuugaaaucuacccaggaagcuauaaacaagauuacuaagaaucucaacucccugagcgaguuagaagucaaaaaucugcagcgacucucgggcgccauggacgagcuucauaacgagauccuggaauuggaugagaagguggacgaccuaagagcagauacgaucucuucccaaauugaacuggccguacuccugucaaaugagggaaucauuaacagugaagacgagcaccuucuggcuuuggagaggaaacucaagaaaaugcugggcccaagcgcgguugaaauagggaauggauguuucgagacaaagcauaagugcaaccagaccugcuuagaucggaucgcagccgguacuuuugacgcuggcgaguucucccugccuaccuuugauucucuaaauauuacagccgcaagccucaacgacgaugggcuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 149343 - RNA, 1758 nt, Artificial Sequence; identical to SEQ ID NO: 149005
  derived and/or modified sequence opt3 from hemagglutinin__InfluenzaB__AGX19568

SEQ ID NO: 149344 - RNA, 1758 nt, Artificial Sequence; identical to SEQ ID NO: 149338
  derived and/or modified sequence opt3 from hemagglutinin__InfluenzaB__AGX19579

SEQ ID NO: 149345 - RNA, 1758 nt, Artificial Sequence; identical to SEQ ID NO: 149005
  derived and/or modified sequence opt3 from hemagglutinin__InfluenzaB__AGX19590

SEQ ID NO: 149346 - RNA, 1758 nt, Artificial Sequence; identical to SEQ ID NO: 149005
  derived and/or modified sequence opt3 from hemagglutinin__InfluenzaB__AGX19601

SEQ ID NO: 149347 - RNA, 1758 nt, Artificial Sequence; identical to SEQ ID NO: 149005
  derived and/or modified sequence opt3 from hemagglutinin__InfluenzaB__AGX19612

SEQ ID NO: 149348 - RNA, 1758 nt, Artificial Sequence
  derived and/or modified sequence opt3 from hemagglutinin__InfluenzaB__AGX19623
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccguggcacucaugaucgcgauuuucgucguguauauggucagccgugauaaugugucuuguucaauaugccuguga

SEQ ID NO: 149349 - RNA, 1758 nt, Artificial Sequence; identical to SEQ ID NO: 149005
  derived and/or modified sequence opt3 from hemagglutinin__InfluenzaB__AGX19634

SEQ ID NO: 149350 - RNA, 1758 nt, Artificial Sequence; identical to SEQ ID NO: 148530
  derived and/or modified sequence opt3 from hemagglutinin__InfluenzaB__AGX19645

SEQ ID NO: 149351 - RNA, 1758 nt, Artificial Sequence; identical to SEQ ID NO: 148581
  derived and/or modified sequence opt3 from hemagglutinin__InfluenzaB__AGX19656

SEQ ID NO: 149352 - RNA, 1758 nt, Artificial Sequence
  derived and/or modified sequence opt3 from hemagglutinin__InfluenzaB__AGX19667
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaagaccugcagcgacucagcggggccauggaugagcuucauaaugaaauccuggaguuggacgaaaaggucgacgaucuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaaugucagcuguucuaucugccuguga

SEQ ID NO: 149353 - RNA, 1758 nt, Artificial Sequence; identical to SEQ ID NO: 149005
  derived and/or modified sequence opt3 from hemagglutinin__InfluenzaB__AGX19678

SEQ ID NO: 149354 - RNA, 1758 nt, Artificial Sequence; identical to SEQ ID NO: 148530
  derived and/or modified sequence opt3 from hemagglutinin__InfluenzaB__AGX19700

SEQ ID NO: 149355 - RNA, 1758 nt, Artificial Sequence
  derived and/or modified sequence opt3 from hemagglutinin__InfluenzaB__AGX19711
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaaaaacaagaccgccacgaauagucucacuauugaagucccguacaucuguaaagagggugaggaucagauaacaguguggggcuuccacuccgacaacgaaacccagauggcuaagcuguauggggauucuaagccccagaaauuuacuagcuccgccaacggagugacaacccacuacgucucacaaauuggcgguuucccuaaucagacggaggacgggggacugccacagaguggccgcaucguuguggauuauaugguacaaaagagcggcaaaaccgggacaauuacuuaccagagaggaauccucuuaccccagaagguguggugcgcgucugguagguccaaagucaucaagggcucacugccucuuauuggggaagcagacuguuugcaugagaaauauggaggccugaacaagagcaagccauacuacaccggugagcacgccaaagcuauagggaauugccccaucugggugaagacaccgcuaaaacucgccaacggcacuaaguaucggccucccgcaaaacugcuuaaggaacgcggauuuuucggcgcuauugccggguuucuggagggagguugggaaggcaugaucgcgggguggcauggauacaccagucacggcgcccacgguguugcaguggcugccgauuugaagucuacacaggaggcuauaaauaaaauuaccaagaaccucaauucccugagcgaauuagaggucaaaaaccugcagcgacucucgggggccauggacgagcuucauaaugaaauccuggaguuggaugaaaagguggacgaccuaagagcagauacuaucucuucccaaauugagcuggccguacuccugucaaacgaaggcaucauuaauagugaggacgagcaccuucuggcuuuggaaaggaaacucaagaagaugcugggaccaagcgcgguugagauaggcaacggguguuucgaaacgaaacauaagugcaaucagacaugcuuagaucggaucgcagccggaaccuuugacgcuggugaguucucccugccuacuuuugauucucuaaacauuaccgccgcaagccucaaugacgauggccuggacaaccacacaauccuuuuguauuacucaaccgccgcuaguucccuggccgugacucucaugaucgcaauuuucgucguguauauggucagccgugauaacgugucuuguucaauaugccuguga

SEQ ID NO: 149356 - RNA, 1758 nt, Artificial Sequence; identical to SEQ ID NO: 149005
  derived and/or modified sequence opt3 from hemagglutinin__InfluenzaB__AGX19722

SEQ ID NO: 149357 - RNA, 1758 nt, Artificial Sequence; identical to SEQ ID NO: 149005
  derived and/or modified sequence opt3 from hemagglutinin__InfluenzaB__AGX19733

SEQ ID NO: 149358 - RNA, 1758 nt, Artificial Sequence; identical to SEQ ID NO: 149005
  derived and/or modified sequence opt3 from hemagglutinin__InfluenzaB__AGX19744

SEQ ID NO: 149359 - RNA, 1758 nt, Artificial Sequence; identical to SEQ ID NO: 148530
  derived and/or modified sequence opt3 from hemagglutinin__InfluenzaB__AGX19755

SEQ ID NO: 149360 - RNA, 1758 nt, Artificial Sequence; identical to SEQ ID NO: 149005
  derived and/or modified sequence opt3 from hemagglutinin__InfluenzaB__AGX19766

SEQ ID NO: 149361 - RNA, 1758 nt, Artificial Sequence; identical to SEQ ID NO: 149338
  derived and/or modified sequence opt3 from hemagglutinin__InfluenzaB__AGX19788

SEQ ID NO: 149362 - RNA, 1758 nt, Artificial Sequence; identical to SEQ ID NO: 149005
  derived and/or modified sequence opt3 from hemagglutinin__InfluenzaB__AGX19799

SEQ ID NO: 149363 - RNA, 1758 nt, Artificial Sequence; identical to SEQ ID NO: 149005
  derived and/or modified sequence opt3 from hemagglutinin__InfluenzaB__AGX19810

SEQ ID NO: 149364 - RNA, 1758 nt, Artificial Sequence
  derived and/or modified sequence opt3 from hemagglutinin__InfluenzaB__AGX19821
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucggggucuauggacgagcuucauaacgaaauccuggaguuggaugaaaagguggacgaccuaagagccgauacgaucuccucacaaauugagcuggcaguacuccugaguaaugaaggcaucauuaacagcgaggacgagcaccuucuggccuuggaaaggaaacucaagaaaaugcugggaccauccgcuguugagauaggcaauggguguuucgaaacaaagcauaagugcaaccagaccugcuuagaucggaucgcggcaggaacuuuugacgccggugaguucucucugccuaccuuugauagccuaaauauuacagcugccucacucaacgacgauggccuggacaaccacaccauccuuuuguauuacaguacugcagccuccagccuggcugugacacucaugaucgccauuuucgucguguauauggucucucgugauaaugugucauguaguauaugccuguga

SEQ ID NO: 149365 - RNA, 1758 nt, Artificial Sequence; identical to SEQ ID NO: 149338
  derived and/or modified sequence opt3 from hemagglutinin__InfluenzaB__AGX19832

SEQ ID NO: 149366 - RNA, 1758 nt, Artificial Sequence; identical to SEQ ID NO: 149005
  derived and/or modified sequence opt3 from hemagglutinin__InfluenzaB__AGX19843

SEQ ID NO: 149367 - RNA, 1758 nt, Artificial Sequence; identical to SEQ ID NO: 149005
  derived and/or modified sequence opt3 from hemagglutinin__InfluenzaB__AGX19854

SEQ ID NO: 149368 - RNA, 1758 nt, Artificial Sequence; identical to SEQ ID NO: 149005
  derived and/or modified sequence opt3 from hemagglutinin__InfluenzaB__AGX19865

SEQ ID NO: 149369 - RNA, 1758 nt, Artificial Sequence; identical to SEQ ID NO: 149338
  derived and/or modified sequence opt3 from hemagglutinin__InfluenzaB__AGX19876

SEQ ID NO: 149370 - RNA, 1758 nt, Artificial Sequence; identical to SEQ ID NO: 149005
  derived and/or modified sequence opt3 from hemagglutinin__InfluenzaB__AGX19887

SEQ ID NO: 149371 - RNA, 1758 nt, Artificial Sequence
  derived and/or modified sequence opt3 from hemagglutinin__InfluenzaB__AGX19898
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgaaaauggguucuuugccacaauggcuugggcaguuccgaaaaacgacaagaauaaaaccgccacgaacccacucacuaucgaggugcccuacauauguacagagggagaagaucagauuaccgucugggguuuccacagugacaaugagacucagauggcuaagcuguauggcgauuccaagccucagaaauuuacaucuagcgccaacggggugaccacgcacuacgugucccaaaucggaggcuucccaaaccagaccgaagacggugggcugccccagucaggacgcauugucguugauuauauggugcagaagaguggcaaaacaggcacuaucaccuaccaaagagggauccucuuaccucagaagguauggugcgcgagcggaaggucuaaagugauuaaggguucccugccacuuauaggcgaggcagacuguuugcaugagaaauaugggggacugaauaagucaaagcccuacuacacaggcgaacacgccaaagcuaucgguaacugcccgauuugggucaagacuccucuaaaacucgccaaugggaccaaguaucggcccccagcaaaacugcuuaaggagcgcggcuuuuucggagcuaucgccggcuuucuggaagggggaugggaggguaugauagcgggcuggcauggguacacaagccacggagcccacggcguggcaguugcugccgauuugaagaguacccaggaagcuauuaacaaaaucacuaagaaucucaacucucuguccgaguuagaggugaaaaaucugcagcgacucagcggugccauggacgaacuucauaacgagauccuggaauuggaugagaaggucgacgaccuaagagcagauacgauuucgucucaaaucgaacuggccgugcuccuguccaaugaggggauuauaaacucagaggacgaacaccuucuggcuuuggagaggaaacucaagaagaugcugggcccuagugcgguagaaaucggaaauggcuguuucgagacaaaacauaagugcaaccagaccugcuuagaucggauugcagccgggacuuuugacgcuggagaguucagccugcccaccuuugauucccuaaauaucacagccgcaucucucaacgacgauggucuggacaaucacaccauccuuuuguauuacagcacugccgcuucaagucuggccguuacacucaugauugcaauauucguggucuauauggugucccgugauaacgucagcuguucuaucugccuguga

SEQ ID NO: 149372 - RNA, 1758 nt, Artificial Sequence; identical to SEQ ID NO: 148530
  derived and/or modified sequence opt3 from hemagglutinin__InfluenzaB__AGX19909

SEQ ID NO: 149373 - RNA, 1758 nt, Artificial Sequence; identical to SEQ ID NO: 149005
  derived and/or modified sequence opt3 from hemagglutinin__InfluenzaB__AGX19920

SEQ ID NO: 149374 - RNA, 1758 nt, Artificial Sequence; identical to SEQ ID NO: 149371
  derived and/or modified sequence opt3 from hemagglutinin__InfluenzaB__AGX19931

SEQ ID NO: 149375 - RNA, 1758 nt, Artificial Sequence; identical to SEQ ID NO: 149338
  derived and/or modified sequence opt3 from hemagglutinin__InfluenzaB__AGX19942

SEQ ID NO: 149376 - RNA, 1758 nt, Artificial Sequence; identical to SEQ ID NO: 149005
  derived and/or modified sequence opt3 from hemagglutinin__InfluenzaB__AGX19953

SEQ ID NO: 149377 - RNA, 1758 nt, Artificial Sequence; identical to SEQ ID NO: 148763
  derived and/or modified sequence opt3 from hemagglutinin__InfluenzaB__AGX19964

SEQ ID NO: 149378 - RNA, 1758 nt, Artificial Sequence; identical to SEQ ID NO: 148530
  derived and/or modified sequence opt3 from hemagglutinin__InfluenzaB__AGX19975

SEQ ID NO: 149379 - RNA, 1758 nt, Artificial Sequence
  derived and/or modified sequence opt3 from hemagglutinin__InfluenzaB__AGX19986
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgugagcgguaggucuaaagucauuaagggcucccugccacuuauaggggaagcggacuguuugcaugagaaauauggaggccugaauaagucaaagcccuacuacacaggugagcacgcaaaagccaucgggaacugcccgauuugggugaagacuccucuaaaacucgcuaauggcaccaaguaucggcccccagccaaacugcuuaaggaacgcggauuuuucggcgcaaucgcuggguuucuggagggagguugggaaggcaugauagccggguggcauggauacacaagccacggcgcgcacgguguugccguggcagcugauuugaagaguacccaggaggccauuaacaaaaucacuaagaaucucaacucucuguccgaauuagaggucaaaaaucugcagcgacucagcggggcuauggacgagcuucauaacgaaauccuggaguuggaugaaaagguggacgaccuaagagccgauacgauuucgucucaaaucgagcuggcaguacuccuguccaaugaaggcauuauaaacucagaggacgagcaccuucuggccuuggaaaggaaacucaagaagaugcugggaccuagugcuguugagaucggcaauggguguuucgaaacaaaacauaagugcaaccagaccugcuuagaucggauugcggcaggaacuuuugacgccggugaguucagccugcccaccuuugauucccuaaauaucacagcugccucucucaacgacgauggccuggacaaucacaccauccuuuuguauuacagcacugcagccucaagucuggcugugacacucaugauugccauauucgucguguauauggucucccgugauaacgugagcuguucuaucugccuguga

SEQ ID NO: 149380 - RNA, 1758 nt, Artificial Sequence
  derived and/or modified sequence opt3 from hemagglutinin__InfluenzaB__AGX19997
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagauugaggacgggggacugccccagucaggccgcaucgucguugauuauauggugcagaagaguggcaaaaccgggacaaucacuuaccaaagagguauucucuuaccucagaagguauggugcgcgagcggaaggucuaaagugauaaagggcucccugccacuuaucggggaagcagacuguuugcaugagaaauauggaggccugaauaagucaaagcccuacuacaccggugagcacgccaaagcuauugggaacugcccgaucugggucaagacaccucuaaaacucgccaauggcacuaaguaucggcccccagcaaaacugcuuaaggaacgcggauuuuucggcgcuauagccggguuucuggagggagguugggaaggcaugauugcgggguggcauggauacaccagccacggcgcccacgguguggcaguugcugccgauuugaagaguacacaggaggcuaucaacaaaaucaccaagaaucucaacucucuguccgaauuagaggugaaaaaucugcagcgacucagcggggccauggacgagcuucauaacgaaauucuggaguuggaugaaaaggucgacgaccuaagagcagauacuaucucgucucaaauugagcuggccgugcuccuguccaaugaaggcauaaucaacucagaggacgagcaccuucuggcuuuggaaaggaaacucaagaagaugcugggaccuagugcgguagagauuggcaauggguguuucgaaacgaaacauaagugcaaccagacaugcuuagaucggaucgcagccggaaccuuugacgcuggugaguucagccugcccacuuuugauucccuaaauaucaccgccgcaucucucaacgacgauggccuggacaaucacacaauucuuuuguauuacagcaccgccgcuucaagucuggccguuacucucaugauagcaaucuucguggucuauauggugucccgugauaacgucagcuguucuauuugccuguga

SEQ ID NO: 149381 - RNA, 1758 nt, Artificial Sequence; identical to SEQ ID NO: 149005
  derived and/or modified sequence opt3 from hemagglutinin__InfluenzaB__AGX20008

SEQ ID NO: 149382 - RNA, 1758 nt, Artificial Sequence; identical to SEQ ID NO: 149005
  derived and/or modified sequence opt3 from hemagglutinin__InfluenzaB__AGX20019

SEQ ID NO: 149383 - RNA, 1758 nt, Artificial Sequence; identical to SEQ ID NO: 149005
  derived and/or modified sequence opt3 from hemagglutinin__InfluenzaB__AGX20030

SEQ ID NO: 149384 - RNA, 1758 nt, Artificial Sequence
  derived and/or modified sequence opt3 from hemagglutinin__InfluenzaB__AGX20041
augaaggccaucauugugcugcucauggucguuaccagcgacgcugauagaauaugcacaggcaucacuuccucuaacucaccccacgugguaaaaacggcaacccagggggaggugaaugucacaggagugauuccucuuacuaccacaccaaccaagagucauuucgccaaccugaaagguaaggaaacuaggggcaaauuguguccgaagugcuuaaauuguacagaccuggauguugcgcuagggcggcccaagugcaccggaaaaaucccuagcgcucgcguguccauucuccacgagguccgaccagugacgucuggcuguuuucccaucaugcaugaccguacuaagauaagacaacugccuaaccuucugagggguuacgaacacauccgguugucgacccauaauguaauuaacgccgagaaugcaccagggggacccuauaaaaucggcacaucaggcagcugcccuaacauuacuaaugggaacggauucuuugccaccauggcuugggcaguuccaaagaaugauaaaaacaagacagccaccaauccgcucacgaucgaagugcccuacauauguacugagggugaggaccagauuacagucuggggcuuccacagugauaacgaaacccagauggcuaagcuguauggggacuccaaaccucagaaguuuacuucuagcgccaauggagugacaacccacuacgugucccaaaucggcgguuucccaaaccagacggaggaugggggacugccccagucaggccgcauugucguugacuauauggugcagaaaaguggcaagaccgggacaaucacuuaccaaagaggaauccucuuaccucagaaaguauggugcgcgagcgguaggucuaaggugauuaaaggcucccugccacuuauaggggaagcagauuguuugcaugagaaguauggaggccugaacaagucaaaacccuacuacaccggugagcacgccaaggcuaucgggaauugcccgauuugggucaaaacaccucuaaagcucgccaacggcacuaaauaucggcccccagcaaagcugcuuaaggaacgcggauuuuucggcgcuaucgccggguuucuggagggagguugggaaggcaugauagcgggguggcauggauacaccagccacggcgcccacgguguggcaguugcugccgacuugaaaaguacacaggaggcuauuaauaagaucaccaaaaaccucaauucucuguccgaauuagaggugaagaaccugcagcgacucagcggggccauggaugagcuucauaaugaaauccuggaguuggacgaaaaagucgacgaucuaagagcagacacuauuucgucucaaaucgagcuggccgugcuccuguccaacgaaggcauuauaaauucagaggaugagcaccuucuggcuuuggaaaggaagcucaagaaaaugcugggaccuagugcgguagagaucggcaacggguguuucgaaacgaagcauaaaugcaaucagacaugcuuagaccggauugcagccggaaccuuugaugcuggugaguucagccugcccacuuuugacucccuaaacaucaccgccgcaucucucaaugaugacggccuggauaaccacacaauccuuuuguauuacagcaccgccgcuucaagucuggccguuacucucaugauugcaauauucguggucuauauggugucccgugacaaugucagcuguucuaucugccuguga

SEQ ID NO: 149385 - RNA, 1758 nt, Artificial Sequence; identical to SEQ ID NO: 149005
  derived and/or modified sequence opt3 from hemagglutinin__InfluenzaB__AGX20052

SEQ ID NO: 149386 - RNA, 1758 nt, Artificial Sequence; identical to SEQ ID NO: 149005
  derived and/or modified sequence opt3 from hemagglutinin__InfluenzaB__AGX20063

SEQ ID NO: 149387 - RNA, 1758 nt, Artificial Sequence
  derived and/or modified sequence opt3 from hemagglutinin__InfluenzaB__AGX20074
augaaggccaucauugcucugcucaugguggucaccagcaacgcagacagaauaugcacaggcaucacuuccucuaauucaccccacguugugaaaacggccacccagggggagguaaacgugacaggagucauuccucuuacuaccacaccaaccaagagucauuucgcgaaucugaaagguacugaaacaaggggcaaguuguguccgaaaugcuuaaacuguaccgaucuggacguggcucuagggcggcccaagugcacgggaaagaucccuagcgcccgcguuuccauucuccacgaggugcgaccagucacuucuggcuguuuucccaucaugcaugaucguaccaaaauaagacaacugccuaaucuucugagggguuacgaacacauccgguugucgacacauaacgugauuaaugcagagaacgccccagggggacccuauaagaucggcacuucaggcagcugcccuaauauuaccaacgggaauggauucuuugcuacaauggcaugggccguaccgaaaaacgacaagaauaaaaccgcuacgaacccacucacuaucgaaguucccuacauauguacagagggugaggaucagauuaccguguggggcuuccacagugacaaugaaacucagauggccaagcuguauggggauuccaagccucagaaauuuacaucuagcgcgaacggagucaccacgcacuacgugucccaaaucggcgguuucccaaaccagaccgaggacgggggacugccccagucaggccgcauuguggucgauuauaugguucagaagaguggcaaaacagggacuaucaccuaccaaagaggaauccucuuaccucagaagguguggugcgcaagcgguaggucuaaaguaauuaagggcucccugccacuuauaggggaagccgacuguuugcaugagaaauauggaggccugaauaagucaaagcccuacuacacaggugagcacgcuaaagccaucgggaacugcccgauuugggugaagacuccucuaaaacucgcaaauggcaccaaguaucggcccccagcuaaacugcuuaaggaacgcggauuuuucggcgccaucgcgggguuucuggagggagguugggaaggcaugauagccggguggcauggauacacaagccacggcgcacacggugucgcuguggccgcugauuugaagaguacccaggaggccauuaacaaaaucacuaagaaucucaacucucuguccgaauuagagguuaaaaaucugcagcgacucagcggggcaauggacgagcuucauaacgaaauccuggaguuggaugaaaagguggacgaccuaagagccgauacgauuucgucucaaaucgagcuggcuguccuccuguccaaugaaggcauuauaaacucagaggacgagcaccuucuggcguuggaaaggaaacucaagaagaugcugggaccuagugcaguggagaucggcaauggguguuucgaaacaaaacauaagugcaaccagaccugcuuagaucggauugccgcuggaacuuuugacgccggugaguucagccugcccaccuuugauucccuaaauaucacagcagccucucucaacgacgauggccuggacaaucacaccauccuuuuguauuacagcacugcugccucaagucuggcaguaacacucaugauugcgauauucguuguguauauggucucccgugauaacgugagcuguucuaucugccuguga

SEQ ID NO: 149388 - RNA, 1758 nt, Artificial Sequence
  derived and/or modified sequence opt3 from hemagglutinin__InfluenzaB__AGX20085
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccaucuggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugguucagaagaguggcaaaacagggacuaucaccuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacacaggugagcacgccaaagcuauugggaacugcccgaucugggugaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacggugucgcaguggcugccgauuugaagaguacccaggaggcuaucaacaaaaucacuaagaaucucaacucucuguccgaauuagagguuaaaaaucugcagcgacucagcggggccauggacgagcuucauaacgaaauucuggaguuggaugaaaagguggacgaccuaagagcagauacgaucucgucucaaauugagcuggccguccuccuguccaaugaaggcauaaucaacucagaggacgagcaccuucuggcuuuggaaaggaaacucaagaagaugcugggaccuagugcgguggagauuggcaauggguguuucgaaacaaaacauaagugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgugauaacgugagcuguucuauuugccuguga

SEQ ID NO: 149389 - RNA, 1758 nt, Artificial Sequence
  derived and/or modified sequence opt3 from hemagglutinin__InfluenzaB__AGX20096
augaaggccaucauugugcugcucauggucguuaccagcaacgcugacagaauaugcacaggcgugacuuccucuaauucaccccacguagugaaaacggcaacccagggggaggucaacgugacaggaguuaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaauauuccuagcgcucgcgucuccauccuccacgaggugcgaccaguaacuucuggcuguuuucccauuaugcaugaucguaccaagaucagacaacugccuaaccuucugagggguuacgaacacauacgguugucgacacauaauguuaucaacgccgagaaugcaccagggggacccuauaaaauuggcacuucaggcagcugcccuaacgugaccaaugggaacggauucuuugccacaauggcuugggcagucccaaagaaugacaacaauaaaaccgccacgaacagucucacuaucgaagugccguacauuuguacagagggugaggaucagaucaccguguggggcuuccacuccgacaacgaaacucagauggcuaagcuguauggggauucuaaaccccagaaguuuacaagcuccgccaauggagucaccacgcacuacguuucacaaauaggcgguuucccuaaccagaccgaggacgggggacugccacagaguggccgcauugugguagauuauauggugcaaaagagcggcaaaacagggacuaucaccuaccagagagguauucucuuaccccagaaggucuggugcgcgucuggaagguccaaagugaucaagggcucacugccucuuaucggggaagcagacuguuugcaugagaaauauggaggccugaauaagagcaaaccauacuacacaggugagcacgccaaggcuauugggaacugccccauauggguuaagacuccgcuaaaacucgccaauggcaccaaguaucggccucccgcaaaacugcuuaaggaacgcggauuuuucggcgcuaucgccggguuucuggagggagguugggaaggcaugauugcgggguggcauggauacacaagucacggcgcccacgguguggcagucgcugccgauuugaaaucuacccaggaggcuaucaacaagauaacuaagaaucucaacucccugagcgaauuagaggugaaaaaucugcagcgacucucgggggccauggacgagcuucauaacgaaauucuggaguuggaugaaaagguagacgaccuaagagcagauacgaucucuucccaaaucgagcuggccguucuccugucaaaugaaggcauuaucaacagugaggacgagcaccuucuggcuuuggaaaggaaacucaagaaaaugcugggaccaagcgcgguggagauuggcaauggguguuucgaaacaaagcauaagugcaaccagaccugcuuagaucggauagcagccggaacuuuugacgcuggugaguucucccugccuaccuuugauucucuaaauaucacagccgcaagccucaacgacgauggccuggacaaccacaccauucuuuuguauuacucaacugccgcuaguucccuggccgucacacucaugaucgcaaucuucguggucuauauggugagccgugauaauguuucuuguucaauuugccuguga

SEQ ID NO: 149390 - RNA, 1758 nt, Artificial Sequence; identical to SEQ ID NO: 148624
  derived and/or modified sequence opt3 from hemagglutinin__InfluenzaB__AGX20107

SEQ ID NO: 149391 - RNA, 1758 nt, Artificial Sequence; identical to SEQ ID NO: 148624
  derived and/or modified sequence opt3 from hemagglutinin__InfluenzaB__AGX20118

SEQ ID NO: 149392 - RNA, 1758 nt, Artificial Sequence; identical to SEQ ID NO: 148624
  derived and/or modified sequence opt3 from hemagglutinin__InfluenzaB__AGX20129

SEQ ID NO: 149393 - RNA, 1758 nt, Artificial Sequence; identical to SEQ ID NO: 148624
  derived and/or modified sequence opt3 from hemagglutinin__InfluenzaB__AGX20140

SEQ ID NO: 149394 - RNA, 1758 nt, Artificial Sequence; identical to SEQ ID NO: 148624
  derived and/or modified sequence opt3 from hemagglutinin__InfluenzaB__AGX20151

SEQ ID NO: 149395 - RNA, 1758 nt, Artificial Sequence; identical to SEQ ID NO: 148624
  derived and/or modified sequence opt3 from hemagglutinin__InfluenzaB__AGX20162

SEQ ID NO: 149396 - RNA, 1758 nt, Artificial Sequence; identical to SEQ ID NO: 148624
  derived and/or modified sequence opt3 from hemagglutinin__InfluenzaB__AGX20173

SEQ ID NO: 149397 - RNA, 1758 nt, Artificial Sequence; identical to SEQ ID NO: 148624
  derived and/or modified sequence opt3 from hemagglutinin__InfluenzaB__AGX20184

SEQ ID NO: 149398 - RNA, 1758 nt, Artificial Sequence; identical to SEQ ID NO: 148624
  derived and/or modified sequence opt3 from hemagglutinin__InfluenzaB__AGX20195

SEQ ID NO: 149399 - RNA, 1758 nt, Artificial Sequence; identical to SEQ ID NO: 148624
  derived and/or modified sequence opt3 from hemagglutinin__InfluenzaB__AGX20206

SEQ ID NO: 149400 - RNA, 1758 nt, Artificial Sequence; identical to SEQ ID NO: 148624
  derived and/or modified sequence opt3 from hemagglutinin__InfluenzaB__AGX20217

SEQ ID NO: 149401 - RNA, 1758 nt, Artificial Sequence; identical to SEQ ID NO: 148661
  derived and/or modified sequence opt3 from hemagglutinin__InfluenzaB__AGX20228

SEQ ID NO: 149402 - RNA, 1758 nt, Artificial Sequence
  derived and/or modified sequence opt3 from hemagglutinin__InfluenzaB__AGX20239
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaauuguguggggcuuccacagugacaaugaaacccagauggcuaagcucuauggggauuccaagccacagaaauuuacuucuagcgccaacggagugacaacccacuacgucucccaaaucggcgguuuccccaaccagacggaggacgggggacugccucagucaggccgcauuguuguggauuauaugguacagaagaguggcaaaaccgggacaaucacuuaccaaagaggaauccugcucccacagaagguguggugcgcgagcgguaggucuaaagucauuaagggcuccuuaccccugauaggggaagcagacugucuucaugagaaauauggaggcuugaauaagucaaagccguacuacaccggugagcacgccaaagcuaucgggaacugcccuauuugggugaagacaccccugaaacuagccaauggcacuaaguaucggccuccagcaaaacuccugaaggaacgcggauuuuucggcgcuaucgccggguuucuugagggagguugggaaggcaugauagcgggguggcauggauacaccagccacggcgcccacgguguugcaguggcugccgaucugaagaguacacaggaggcuauuaacaaaaucaccaagaauuugaacucucucuccgaacuggaggucaaaaauuuacagcgacugagcggggccauggacgagcuccauaacgaaauccuugagcuggaugaaaagguggacgacuugagagcagauacuauuucgucucaaaucgagcuagccguacugcucuccaaugaaggcauuauaaacucagaggacgagcaucugcuugcucuggaaaggaaauugaagaagaugcucggacccagugcgguugagaucggcaauggguguuucgaaacgaaacacaagugcaaccagacaugccuggaucggauugcagccggaaccuuugacgcuggugaguucagcuuaccaacuuuugauucccugaauaucaccgccgcaucucuaaacgacgauggccucgacaaucacacaauccugcuuuauuacagcaccgccgcuucaaguuuggccgugacucugaugauugcaauauucgucguguauauggucucccgugauaacgugagcuguucuaucugccucuga

SEQ ID NO: 149403 - RNA, 1758 nt, Artificial Sequence; identical to SEQ ID NO: 148624
  derived and/or modified sequence opt3 from hemagglutinin__InfluenzaB__AGX20250

SEQ ID NO: 149404 - RNA, 1758 nt, Artificial Sequence; identical to SEQ ID NO: 148624
  derived and/or modified sequence opt3 from hemagglutinin__InfluenzaB__AGX20261

SEQ ID NO: 149405 - RNA, 1758 nt, Artificial Sequence; identical to SEQ ID NO: 148624
  derived and/or modified sequence opt3 from hemagglutinin__InfluenzaB__AGX20272

SEQ ID NO: 149406 - RNA, 1758 nt, Artificial Sequence; identical to SEQ ID NO: 148624
  derived and/or modified sequence opt3 from hemagglutinin__InfluenzaB__AGX20283

SEQ ID NO: 149407 - RNA, 1758 nt, Artificial Sequence; identical to SEQ ID NO: 148624
  derived and/or modified sequence opt3 from hemagglutinin__InfluenzaB__AGX20294

SEQ ID NO: 149408 - RNA, 1758 nt, Artificial Sequence
  derived and/or modified sequence opt3 from hemagglutinin__InfluenzaB__AGX20305
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccaguugacuauugaaguccccuacaucuguacagagggugaggaucagauaaccguguggggcuuccacagugacaaugaaacucagauggcuaagcucuauggggauuccaagccucaaaaauuuacaucuagcgccaacggagugaccacgcacuacgucucccagauuggcgguuucccaaaccagaccgaggacgggggacugccccagucaggccgcaucguuguggauuauaugguacaaaagaguggcaaaacagggacuauuaccuaccagagaggaauccugcucccucagaagguguggugcgcgagcgguaggucuaaagucaucaagggcuccuuaccacugauuggggaagcagacugucuucaugagaaauauggaggcuugaauaagucaaagcccuacuacacaggugagcacgccaaagcuauagggaacugcccgaucugggugaagacuccucugaaacuagccaauggcaccaaguaucggcccccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacaacgacugagcggggccauggacgagcuccauaacgaaauccuugagcuggaugaaaagguggacgacuugagagcagauacgaucucgucucagauugagcuagccguacugcucuccaaugaaggcaucauuaacucagaggacgagcaucugcuugcucuggaaaggaaauugaagaagaugcucggaccuagugcgguugagauaggcaauggguguuucgaaacaaaacacaagugcaaccagaccugccuggaucggaucgcagccggaacuuuugacgcuggugaguucagcuuacccaccuuugauucccugaauauuacagccgcaucucuaaacgacgauggccucgacaaucacaccauccugcuuuauuacagcacugccgcuucaaguuuggccgugacacugaugaucgcaauuuucgucguguauauggucucccgugauaacgugagcuguucuauaugccucuga

SEQ ID NO: 149409 - RNA, 1758 nt, Artificial Sequence; identical to SEQ ID NO: 148624
  derived and/or modified sequence opt3 from hemagglutinin__InfluenzaB__AGX20316

SEQ ID NO: 149410 - RNA, 1758 nt, Artificial Sequence; identical to SEQ ID NO: 148624
  derived and/or modified sequence opt3 from hemagglutinin__InfluenzaB__AGX20327

SEQ ID NO: 149411 - RNA, 1758 nt, Artificial Sequence
  derived and/or modified sequence opt3 from hemagglutinin__InfluenzaB__AGX20338
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaaccucuauggggauuccaagccacagaaguuuacaucuagcgccaacggagugaccacgcacuacgucucccaaauuggcgguuuccccaaucagaccgaggacgggggacugccucagucaggccgcaucguuguggauuauaugguacagaaaaguggcaagacagggacuauuaccuaccaaagaggaauccugcucccacagaaaguguggugcgcgagcgguaggucuaaggucaucaaaggcuccuuaccccugauuggggaagcagacugucuucaugagaaguauggaggcuugaacaaaucaaagccguacuacacaggugagcacgccaaggcuauagggaauugcccuaucugggugaaaacuccccugaagcuagccaacggcaccaaauaucggccuccagcaaagcuccugaaagaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaauaagauuacuaaaaaccuuaauucucucuccgaacuggaggucaagaacuuacagcgacugagcggggccauggacgagcuccauaaugaaauccuugagcuggaugaaaaaguggacgacuugagagcagauacgaucucgucucaaauugagcuagccguacugcucuccaacgaaggcaucauuaauucagaggacgagcaccuguuggcucuggaaaggaaguugaaaaagaugcucggacccagugcgguugagauaggcaacggguguuucgaaacaaagcauaaaugcaaucagaccugccuggaucggaucgcagccggaacuuuugacgcuggugaguucagcuuaccaaccuuugauucccugaacauuacagccgcaucucuaaaugacgauggccucgacaaccacaccauccugcuuuauuacagcacugccgcuucaaguuuggccgugacacugaugaucgcaauuuucgucguguauauggucucccgugauaacgugagcuguucuauaugccucuga

SEQ ID NO: 149412 - RNA, 1758 nt, Artificial Sequence; identical to SEQ ID NO: 148624
  derived and/or modified sequence opt3 from hemagglutinin__InfluenzaB__AGX20349

SEQ ID NO: 149413 - RNA, 1758 nt, Artificial Sequence; identical to SEQ ID NO: 148624
  derived and/or modified sequence opt3 from hemagglutinin__InfluenzaB__AGX20360

SEQ ID NO: 149414 - RNA, 1758 nt, Artificial Sequence; identical to SEQ ID NO: 148661
  derived and/or modified sequence opt3 from hemagglutinin__InfluenzaB__AGX20371

SEQ ID NO: 149415 - RNA, 1758 nt, Artificial Sequence
  derived and/or modified sequence opt3 from hemagglutinin__InfluenzaB__AGX20382
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccaugaacgagcuccauaaugaaauccuugagcuggacgaaaagguggaugacuugagagcagacacgaucucgucucaaauugagcuagccguacugcucuccaacgaaggcaucauuaauucagaggaugagcaucugcuugcucuggaaaggaaauugaagaagaugcucggacccagugcgguugagauaggcaacggguguuucgaaacaaaacacaagugcaaucagaccugccuggaccggaucgcagccggaacuuuugaugcuggugaguucagcuuaccaaccuuugacucccugaacauuacagccgcaucucuaaaugaugacggccucgauaaccacaccauccugcuuuauuacagcacugccgcuucaaguuuggccgugacacugaugaucgcaauuuucgucguguauauggucucccgugacaacgugagcuguucuauaugccucuga

SEQ ID NO: 149416 - RNA, 1758 nt, Artificial Sequence; identical to SEQ ID NO: 148624
  derived and/or modified sequence opt3 from hemagglutinin__InfluenzaB__AGX20393

SEQ ID NO: 149417 - RNA, 1758 nt, Artificial Sequence; identical to SEQ ID NO: 148661
  derived and/or modified sequence opt3 from hemagglutinin__InfluenzaB__AGX20404

SEQ ID NO: 149418 - RNA, 1758 nt, Artificial Sequence; identical to SEQ ID NO: 148624
  derived and/or modified sequence opt3 from hemagglutinin__InfluenzaB__AGX20415

SEQ ID NO: 149419 - RNA, 1758 nt, Artificial Sequence; identical to SEQ ID NO: 148624
  derived and/or modified sequence opt3 from hemagglutinin__InfluenzaB__AGX20426

SEQ ID NO: 149420 - RNA, 1758 nt, Artificial Sequence; identical to SEQ ID NO: 148624
  derived and/or modified sequence opt3 from hemagglutinin__InfluenzaB__AGX20437

SEQ ID NO: 149421 - RNA, 1758 nt, Artificial Sequence; identical to SEQ ID NO: 148624
  derived and/or modified sequence opt3 from hemagglutinin__InfluenzaB__AGX20448

SEQ ID NO: 149422 - RNA, 1758 nt, Artificial Sequence; identical to SEQ ID NO: 148624
  derived and/or modified sequence opt3 from hemagglutinin__InfluenzaB__AGX20459

SEQ ID NO: 149423 - RNA, 1758 nt, Artificial Sequence; identical to SEQ ID NO: 148624
  derived and/or modified sequence opt3 from hemagglutinin__InfluenzaB__AGX20470

SEQ ID NO: 149424 - RNA, 1758 nt, Artificial Sequence; identical to SEQ ID NO: 148624
  derived and/or modified sequence opt3 from hemagglutinin__InfluenzaB__AGX20481

SEQ ID NO: 149425 - RNA, 1758 nt, Artificial Sequence; identical to SEQ ID NO: 148624
  derived and/or modified sequence opt3 from hemagglutinin__InfluenzaB__AGX20492

SEQ ID NO: 149426 - RNA, 1758 nt, Artificial Sequence; identical to SEQ ID NO: 148624
  derived and/or modified sequence opt3 from hemagglutinin__InfluenzaB__AGX20503

SEQ ID NO: 149427 - RNA, 1758 nt, Artificial Sequence; identical to SEQ ID NO: 148624
  derived and/or modified sequence opt3 from hemagglutinin__InfluenzaB__AGX20514

SEQ ID NO: 149428 - RNA, 1758 nt, Artificial Sequence
  derived and/or modified sequence opt3 from hemagglutinin__InfluenzaB__AGX20525
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucagcaaucugaaagguacugaaacaaggggcaaguuguguccgaaaugccccaacuguaccgauuuagacguugcccuggggcggccuaagugcacgggaaagaucccauccgcgcgcgugucuauucuacacgagguccgacccgugacuucgggcuguuuuccuaucaugcaugaucguaccaaaauaagacaacucccaaaucugcuuagggguuacgaacacauccggcugucaacacauaacguaauuaaugcugagaacgcccccgggggaccuuauaagaucggcacuagcggcaguugcccaaauguuaccaacgggaauggauucuuugcaacaauggccugggcugugccgaaaaacgacaagaauaaaaccgcaacgaaccccuugacuauugaagucccuuacaucuguacagagggugaggaucagauaaccguguggggcuuccacuccgacaaugaaacucagauggccaagcucuauggggauucuaagccacagaaauuuacaagcuccgcuaacggagugaccacgcacuacgucucacaaauuggcgguuuccccaaccagaccgaggacgggggacugccucagaguggccgcaucguuguggauuauaugguacaaaagagcggcaaaacagggacuauuaccuaccagagaggaauccugcucccacagaagguguggugcgccucugguagguccaaagucaucaagggcucauuaccccugauuggggaagcggacugucuucaugagaaauauggaggcuugaauaagagcaagccguacuacacaggugagcacgcaaaagccauagggaacugcccuaucugggugaagacuccccugaaacuagcuaauggcaccaaguaucggccuccagccaaacuccugaaggaacgcggauuuuucggcgcaauugcuggguuucuugagggagguugggaaggcaugaucgccggguggcauggauacacaagucacggcgcgcacgguguugccguggcagcugaucugaagucuacccaggaggccauaaacaaaauuacuaagaauuugaacucccucagcgaacuggaggucaaaaauuuacagcgacugucgggggcuauggacgagcuccauaacgaaauccuugagcuggaugaaaagguggacgacuugagagccgauacgaucucuucccaaauugagcuagcaguacugcucucaaaugaaggcaucauuaacagugaggacgagcaucugcuugcccuggaaaggaaauugaagaagaugcucggacccagcgcuguugagauaggcaauggguguuucgaaacaaaacacaagugcaaccagaccugccuggaucggaucgcggcaggaacuuuugacgccggugaguucuccuuaccaaccuuugauucucugaauauuacagcugccagccuaaacgacgauggccucgacaaucacaccauccugcuuuauuacucaacugcagccaguuccuuggcugugacacugaugaucgccauuuucgucguguauauggucagccgugauaacgugucuuguucaauaugccucuga

SEQ ID NO: 149429 - RNA, 1758 nt, Artificial Sequence; identical to SEQ ID NO: 148624
  derived and/or modified sequence opt3 from hemagglutinin__InfluenzaB__AGX20536

SEQ ID NO: 149430 - RNA, 1758 nt, Artificial Sequence
  derived and/or modified sequence opt3 from hemagglutinin__InfluenzaB__AGX20547
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcaccaugucucccaaauuggcgguuucccaaaccagaccgaggacgggggacugccccagucaggccgcaucguuguggauuacaugguacagaagaguggcaaaacagggacuauuaccuaucaaagaggaauccucuuaccucagaagguguggugcgcgagcgguaggucuaaagucaucaagggcucccugccacuuauuggggaagcagacuguuugcacgagaaauacggaggccugaauaagucaaagcccuauuacacaggugagcaugccaaagcuauagggaacugcccgaucugggugaagacuccucuaaaacucgccaauggcaccaaguaccggcccccagcaaaacugcuuaaggaacgcggauuuuucggcgcuauugccggguuucuggagggagguugggaaggcaugaucgcgggguggcacggauauacaagccacggcgcccaugguguugcaguggcugccgauuugaagaguacccaggaggcuauaaacaaaauuacuaagaaucucaacucucuguccgaauuagagaucaaaaaucugcagcgacucagcggggccauggacgagcuucacaacgaaauccuggaguuggaugaaaaggucgacgaccuaagagcagauacgauuucgucucaaaucgagcuggccgugcuccuguccaaugaaggcauuauaaacucagaggacgagcaucuucuggcuuuggaaaggaaacucaagaagaugcugggaccuagugcgguagagaucggcaauggguguuucgaaacaaaacacaagugcaaccagaccugcuuagaucggauugcagccggaacuuuugacgcuggugaguucagccugcccaccuuugauucccuaaauaucacagccgcaucucucaacgacgauggccuggacaaucauaccauccuuuuguacuauagcacugccgcuucaagucuggccguuacacucaugauugcaauauucguggucuacauggugucccgugauaacgucagcuguucuaucugccuguga

SEQ ID NO: 149431 - RNA, 1758 nt, Artificial Sequence; identical to SEQ ID NO: 148678
  derived and/or modified sequence opt3 from hemagglutinin__InfluenzaB__AGX20558

SEQ ID NO: 149432 - RNA, 1758 nt, Artificial Sequence; identical to SEQ ID NO: 148624
  derived and/or modified sequence opt3 from hemagglutinin__InfluenzaB__AGX20569

SEQ ID NO: 149433 - RNA, 1758 nt, Artificial Sequence; identical to SEQ ID NO: 148661
  derived and/or modified sequence opt3 from hemagglutinin__InfluenzaB__AGX20580

SEQ ID NO: 149434 - RNA, 1758 nt, Artificial Sequence; identical to SEQ ID NO: 148624
  derived and/or modified sequence opt3 from hemagglutinin__InfluenzaB__AGX20591

SEQ ID NO: 149435 - RNA, 1758 nt, Artificial Sequence; identical to SEQ ID NO: 148624
  derived and/or modified sequence opt3 from hemagglutinin__InfluenzaB__AGX20602

SEQ ID NO: 149436 - RNA, 1758 nt, Artificial Sequence; identical to SEQ ID NO: 148624
  derived and/or modified sequence opt3 from hemagglutinin__InfluenzaB__AGX20613

SEQ ID NO: 149437 - RNA, 1758 nt, Artificial Sequence; identical to SEQ ID NO: 148624
  derived and/or modified sequence opt3 from hemagglutinin__InfluenzaB__AGX20624

SEQ ID NO: 149438 - RNA, 1758 nt, Artificial Sequence
  derived and/or modified sequence opt3 from hemagglutinin__InfluenzaB__AGX20635
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucugauggcuaagcuguauggggauuccaagccucagaaauuuacaucuagcgccaacggagugaccacgcacuacgucucccagauuggcgguuucccaaaccaaaccgaggacgggggacucccccagucaggccgcaucguuguggauuauaugguacagaagaguggcaaaacagggacuauuaccuaccagagaggaaucuuacugccucaaaagguguggugcgcgagcgguaggucuaaagucaucaagggcucccuuccauugauuggggaagcagacugucugcaugagaaauauggaggccuaaauaagucaaagcccuacuacacaggugagcacgccaaagcuauagggaacugcccgaucugggugaagacuccucucaaacuggccaauggcaccaaguaucggcccccagcaaaacuucugaaggaacgcggauuuuucggcgcuauugccggguuuuuggagggagguugggaaggcaugaucgcgggguggcauggauacacaagccacggcgcccacgguguugcaguggcugccgaucucaagaguacccaggaggcuauaaacaaaauuacuaagaaucugaacucuuuauccgaacuggaggucaaaaaucuccagcgacuuagcggggccauggacgagcugcauaacgaaaucuuggagcuagaugaaaagguggacgaccugagagcagauacgaucucgucucagauugagcucgccguacugcuuuccaaugaaggcaucauuaacucagaggacgagcaccuguuggcucucgaaaggaaacugaagaagauguuaggaccuagugcgguugagauaggcaauggguguuucgaaacaaaacauaagugcaaccaaaccugccuggaucggaucgcagccggaacuuuugacgcuggugaguucagccuacccaccuuugauucccucaauauuacagccgcaucucugaacgacgauggccuugacaaucacaccaucuugcuguauuacagcacugccgcuucaagucucgccgugacacugaugaucgcaauuuucgucguguauauggucucccgugauaacgugagcuguucuauaugccuuuga

SEQ ID NO: 149439 - RNA, 1758 nt, Artificial Sequence; identical to SEQ ID NO: 148624
  derived and/or modified sequence opt3 from hemagglutinin__InfluenzaB__AGX20646

SEQ ID NO: 149440 - RNA, 1758 nt, Artificial Sequence
  derived and/or modified sequence opt3 from hemagglutinin__InfluenzaB__AGX20668
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaccaaaacggccacuaaucccuugacaauugaagucccuuacaucuguaccgagggugaggaucagauaacuguguggggcuuccacagugacaacgaaacacagauggcuaagcucuauggggauuccaagccacagaaauuuaccucuagcgccaauggagugacgacccacuacgucucccaaauuggcgguuuccccaaccagacagaggacgggggacugccucagucaggccgcaucguuguggauuauaugguacagaagaguggcaaaacugggaccauuacauaccaaagaggaauccugcucccacagaagguguggugcgcgagcgguaggucuaaagucaucaagggcuccuuaccccugauuggggaagcagacugucuucaugagaaauauggaggcuugaacaagucaaagccguacuacacuggugagcacgccaaagcuauagggaauugcccuaucugggugaagaccccacugaaacuagccaacggcacaaaguaucggcccccugcaaaacuccugaaggaacgcggauuuuucggcgcuauugccggguuucuugagggagguugggaaggcaugaucgcgggguggcauggauacaccagccacggcgcccacgguguugcaguggcugccgaucugaagaguacucaggaggcuauaaauaaaauuacgaagaaccuuaauucucucuccgaacuggaggucaaaaacuuacagcgacugagcggggccauggacgagcuccauaaugaaauccuugagcuggaugaaaagguggacgacuugagagcagauacaaucucgucucaaauugagcuagccguacugcucuccaacgaaggcaucauuaauucagaggacgagcaccuguuggcucuggaaaggaaauugaagaagaugcucggacccagugcgguugagauaggcaacggguguuucgaaaccaaacauaagugcaaucagacuugccuggaucggaucgcagccggaaccuuugacgcuggugaguucagcuuaccaacauuugauucccugaacauuaccgccgcaucucuaaaugacgauggccucgacaaccacacuauccugcuuuauuacagcacagccgcuucaaguuuggccgugacgcugaugaucgcaauuuucgucguguauauggucucccgugauaaugugagcuguucuauaugccucuga

SEQ ID NO: 149441 - RNA, 1758 nt, Artificial Sequence; identical to SEQ ID NO: 148699
  derived and/or modified sequence opt3 from hemagglutinin__InfluenzaB__AGX20679

SEQ ID NO: 149442 - RNA, 1758 nt, Artificial Sequence; identical to SEQ ID NO: 148661
  derived and/or modified sequence opt3 from hemagglutinin__InfluenzaB__AGX20690

SEQ ID NO: 149443 - RNA, 1758 nt, Artificial Sequence; identical to SEQ ID NO: 148661
  derived and/or modified sequence opt3 from hemagglutinin__InfluenzaB__AGX20701

SEQ ID NO: 149444 - RNA, 1758 nt, Artificial Sequence; identical to SEQ ID NO: 149005
  derived and/or modified sequence opt3 from hemagglutinin__InfluenzaB__AGX20712

SEQ ID NO: 149445 - RNA, 1758 nt, Artificial Sequence; identical to SEQ ID NO: 148624
  derived and/or modified sequence opt3 from hemagglutinin__InfluenzaB__AGX20723

SEQ ID NO: 149446 - RNA, 1758 nt, Artificial Sequence
  derived and/or modified sequence opt3 from hemagglutinin__InfluenzaB__AGX20734
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacaaacaauguaauuaacgccgagaaugcaccagggggacccuauaagaucggcacuucaggcagcugcccuaacguuaccaaugggaacggauucuuugccacaauggcuugggcagugccgaaaaaugacaagaacaaaaccgccacgaauccacucacuauugaaguccccuacaucuguacagagggugaggaucagauaaccguguggggcuuccauagugacaacgaaacucagauggcuaagcuguauggggauuccaagccucagaaauuuacaucuagcgccaacggagugaccacgcacuacgucucccaaauuggcgguuucccaaaucagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcacgagaaauauggaggccugaacaagucaaagcccuacuacacaggugagcaugccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcacggauacacaagccauggcgcccacgguguugcaguggcugccgauuugaagaguacccaggaggcuauaaauaaaauuacuaagaaccucaauucucuguccgaauuagaggucaaaaaccugcagcgacucagcggggccauggacgagcuucacaaugaaauccuggaguuggaugaaaagguggacgaccuaagagcagauacgaucucgucucaaauugagcuggccguacuccuguccaacgaaggcaucauuaauucagaggacgagcaucuucuggcuuuggaaaggaaacucaagaagaugcugggaccuagugcgguugagauaggcaacggguguuucgaaacaaaacacaagugcaaucagaccugcuuagaucggaucgcagccggaacuuuugacgcuggugaguucagccugcccaccuuugauucccuaaacauuacagccgcaucucucaaugacgauggccuggacaaccauaccauccuuuuguauuacagcacugccgcuucaagucuggccgugacacucaugaucgcaauuuucgucguguauauggucucccgugauaacgugagcuguucuauaugccuguga

SEQ ID NO: 149447 - RNA, 1758 nt, Artificial Sequence
  derived and/or modified sequence opt3 from hemagglutinin__InfluenzaB__AGX20745
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccauuuggggcuuccacagugacaaugaaacucagauggcuaagcucuauggggauuccaagccacagaaauuuacaucuagcgccaacggagugaccacgcacuacgugucccaaaucggcgguuuccccaaccagaccgaggacgggggacugccucagucaggccgcauugucguugauuauauggugcagaagaguggcaaaacagggacuaucaccuaccaaagaggaauccugcucccacagaagguauggugcgcgagcgguaggucuaaagugauuaagggcuccuuaccccugauaggggaagcagacugucuucaugagaaauauggaggcuugaauaagucaaagccguacuacacaggugagcacgccaaagcuaucgggaacugcccuauuugggucaagacuccccugaaacuagccaauggcaccaaguaucggccuccagcaaaacuccugaaggaacgcggauuuuucggcgcuaucgccggguuucuugagggagguugggaaggcaugauagcgggguggcauggauacacaagccacggcgcccacgguguggcaguugcugccgaucugaagaguacccaggaggcuauuaacaaaaucacuaagaauuugaacucucucuccgaacuggaggugaaaaauuuacagcgacugagcggggccauggacgagcuccauaacgaaauccuugagcuggaugaaaaggucgacgacuugagagcagauacgauuucgucucaaaucgagcuagccgugcugcucuccaaugaaggcauuauaaacucagaggacgagcaucugcuugcucuggaaaggaaauugaagaagaugcucggacccagugcgguagagaucggcaauggguguuucgaaacaaaacacaagugcaaccagaccugccuggaucggauugcagccggaacuuuugacgcuggugaguucagcuuaccaaccuuugauucccugaauaucacagccgcaucucuaaacgacgauggccucgacaaucacaccauccugcuuuauuacagcacugccgcuucaaguuuggccguuacacugaugauugcaauauucguggucuauauggugucccgugauaacgucagcuguucuaucugccucuga

SEQ ID NO: 149448 - RNA, 1758 nt, Artificial Sequence; identical to SEQ ID NO: 149005
  derived and/or modified sequence opt3 from hemagglutinin__InfluenzaB__AGX20756

SEQ ID NO: 149449 - RNA, 1758 nt, Artificial Sequence; identical to SEQ ID NO: 148624
  derived and/or modified sequence opt3 from hemagglutinin__InfluenzaB__AGX20767

SEQ ID NO: 149450 - RNA, 1758 nt, Artificial Sequence; identical to SEQ ID NO: 148661
  derived and/or modified sequence opt3 from hemagglutinin__InfluenzaB__AGX20778

SEQ ID NO: 149451 - RNA, 1758 nt, Artificial Sequence
  derived and/or modified sequence opt3 from hemagglutinin__InfluenzaB__AGX20789
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauggcgaaauccuugagcuggaugaaaagguggacgacuugagagcagauacgaucucgucucaaauugagcuagccguacugcucuccaacgaaggaaucauuaauucagaggacgagcaucugcuugcucuggaaaggaaauugaagaagaugcucggccccagugcgguugagauagggaacggauguuucgaaacaaaacacaagugcaaucagaccugccuggaucggaucgcagccgguacuuuugacgcuggcgaguucagcuuaccaaccuuugauucccugaacauuacagccgcaucucuaaaugacgaugggcucgacaaccacaccauccugcuuuauuacagcacugccgcuucaaguuuggccgugacacugaugaucgcaauuuucgucguguauauggucucccgugauaaugugagcuguucuauaugccucuga

SEQ ID NO: 149452 - RNA, 1758 nt, Artificial Sequence
  derived and/or modified sequence opt3 from hemagglutinin__InfluenzaB__AGX20800
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggaucggaucgcagccggaacuuuugacgcuggugaguucagcuuaccaaccuuugauucccugaauauuacagccgcaucucuaaacgacgaugaacucgacaaucacaccauccugcuuuauuacagcacugccgcuucaaguuuggccgugacacugaugaucgcaauuuucgucguguauauggucucccgugauaacgugagcuguucuauaugccucuga

SEQ ID NO: 149453 - RNA, 1758 nt, Artificial Sequence; identical to SEQ ID NO: 148699
  derived and/or modified sequence opt3 from hemagglutinin__InfluenzaB__AGX20811

SEQ ID NO: 149454 - RNA, 1758 nt, Artificial Sequence; identical to SEQ ID NO: 148699
  derived and/or modified sequence opt3 from hemagglutinin__InfluenzaB__AGX20822

SEQ ID NO: 149455 - RNA, 1758 nt, Artificial Sequence; identical to SEQ ID NO: 148699
  derived and/or modified sequence opt3 from hemagglutinin__InfluenzaB__AGX20833

SEQ ID NO: 149456 - RNA, 1758 nt, Artificial Sequence
  derived and/or modified sequence opt3 from hemagglutinin__InfluenzaB__AGX20844
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcaugggaaagauuccuagcgcucgcguuuccauccuccacgaggugcgaccagucacgucuggcuguuuucccauaaugcaugaucguacuaaaaucagacaacugccuaaucuucugagggguuacgaacacauucgguugucgacccauaacgugaucaaugccgagaacgcaccagggggacccuauaagauuggcacaucaggcagcugcccuaauaucacuaacgggaauggauucuuugccaccauggcuugggcaguaccgaaaaacgacaagaauaaaacagccaccaacccacucacgauagaaguucccuacauuuguacugagggugaggaucagaucacaguguggggcuuccacagugacaaugaaacccagauggcuaagcuguauggggauuccaagccucagaaauuuacuucuagcgccaacggagucacaacccacuacgugucccaaauuggcgguuucccaaaccagacggaggacgggggacugccccagucaggccgcaucguggucgauuauaugguucagaagaguggcaaaaccgggacaaucacuuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacaccggugagcacgccaaagcuauugggaacugcccgaucugggugaagacaccucuaaaacucgccaauggcacuaaguaucggcccccagcaaaacugcuuaaggaacgcggauuuuucggcgcuauagccggguuucuggagggagguugggaaggcaugauugcgggguggcauggauacaccagccacggcgcccacggugucgcaguggcugccgauuugaagaguacacaggaggcuaucaacaaaaucaccaagaaucucaacucucuguccgaauuagagguuaaaaaucugcagcgacucagcggggccauggacgagcuucauaacgaaauucuggaguuggaugaaaagguggacgaccuaagagcagauacuaucucgucucaaauugagcuggccguccuccuguccaaugaaggcauaaucaacucagaggacgagcaccuucuggcuuuggaaaggaaacucaagaagaugcugggaccuagugcgguggagauuggcaauggguguuucgaaacgaaacauaagugcaaccagacaugcuuagaucggaucgcagccggaaccuuugacgcuggugaguucagccugcccacuuuugauucccuaaauaucaccgccgcaucucucaacgacgauggccuggacaaucacacaauucuuuuguauuacagcaccgccgcuucaagucuggccguaacucucaugauagcaaucuucguuguguauauggucucccgugauaacgugagcuguucuauuugccuguga

SEQ ID NO: 149457 - RNA, 1758 nt, Artificial Sequence; identical to SEQ ID NO: 148624
  derived and/or modified sequence opt3 from hemagglutinin__InfluenzaB__AGX20855

SEQ ID NO: 149458 - RNA, 1758 nt, Artificial Sequence; identical to SEQ ID NO: 148699
  derived and/or modified sequence opt3 from hemagglutinin__InfluenzaB__AGX20866

SEQ ID NO: 149459 - RNA, 1758 nt, Artificial Sequence; identical to SEQ ID NO: 148699
  derived and/or modified sequence opt3 from hemagglutinin__InfluenzaB__AGX20877

SEQ ID NO: 149460 - RNA, 1758 nt, Artificial Sequence
  derived and/or modified sequence opt3 from hemagglutinin__InfluenzaB__AGX20888
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacuccgaaacucagauggcuaagcucuauggggauucuaagccacagaaauuuacaagcuccgccaauggagugaccacgcacuacgucucacaaauuggcgguuuccccaaccagaccgaggacgggggacugccucagaguggccgcaucguuguggauuauaugguacagaaguccggcaaaacagggacuauuaccuaccaaagaggaauccugcucccacagaagguguggugcgcgucugguagguccaaagucaucaagggcucauuaccccugauuggggaagcagacugucuucaugagaaauauggaggcuugaacaagagcaagccguacuacacaggugagcacgccaaagcuauagggaauugcccuaucugggugaagacuccccugaaacuagccaacggcaccaaguaucggccuccagcaaaacuccugaaggaacgcggauuuuucggcgcuauugccggguuucuugagggagguugggaaggcaugaucgcgggguggcauggauacacaagucacggcgcccacgguguugcaguggcugccgaucugaagucuacccaggaggcuauaaauaaaauuacuaagaacuugaauagccucagcgaacuggaggucaaaaacuuacagcgacugucgggggccauggacgagcuccauaaugaaauccuugagcuggaugaaaagguggacgacuugagagcagauacgaucucuucccaaauugagcuagccguacugcucucaaacgaaggcaucauuaauagugaggacgagcaucugcuugcucuggaaaggaaauugaagaagaugcucggacccagcgcgguugagauaggcaacggguguuucgaaacaaaacacaagugcaaucagaccugccuggaucggaucgcagccggaacuuuugacgcuggugaguucuccuuaccaaccuuugauucucugaacauuacagccgcaagccuaaaugacgauggccucgacaaccacaccauccugcuuuauuacucaacugccgcuaguuccuuggccgugacacugaugaucgcaauuuucgucguguauauggucagccgugauaaugugucuuguucaauaugccucuga

SEQ ID NO: 149461 - RNA, 1758 nt, Artificial Sequence; identical to SEQ ID NO: 148699
  derived and/or modified sequence opt3 from hemagglutinin__InfluenzaB__AGX20899

SEQ ID NO: 149462 - RNA, 1758 nt, Artificial Sequence; identical to SEQ ID NO: 148699
  derived and/or modified sequence opt3 from hemagglutinin__InfluenzaB__AGX20910

SEQ ID NO: 149463 - RNA, 1758 nt, Artificial Sequence; identical to SEQ ID NO: 148624
  derived and/or modified sequence opt3 from hemagglutinin__InfluenzaB__AGX20921

SEQ ID NO: 149464 - RNA, 1758 nt, Artificial Sequence
  derived and/or modified sequence opt3 from hemagglutinin__InfluenzaB__AGX20932
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauccaaagccccagaaauuuacauccucugccaacggagugaccacgcacuacgucagccaaauuggcgguuucccuaaccagaccgaggacgggggacugccacaguccggccgcaucguuguggauuauaugguacagaagucaggcaaaacagggacuauuaccuaccaaagaggaauccugcucccccagaagguguggugcgcgagugguaggagcaaagucaucaagggcucuuuaccgcugauuggggaagcagacugucuucaugagaaauauggaggcuugaauaaguccaagccuuacuacacaggugagcacgccaaagcuauagggaacugccccaucugggugaagacuccacugaaacuagccaauggcaccaaguaucggccucccgcaaaacuccugaaggaacgcggauuuuucggcgcuauugccggguuucuugagggagguugggaaggcaugaucgcgggguggcauggauacacaucacacggcgcccacgguguugcaguggcugccgaucugaaaagcacccaggaggcuauaaacaagauuacuaagaauuugaacagucucucugaacuggaggucaaaaauuuacagcgacuguccggggccauggacgagcuccauaacgaaauccuugagcuggaugaaaagguggacgacuugagagcagauacgaucagcucgcaaauugagcuagccguacugcucucuaaugaaggcaucauuaacuccgaggacgagcaucugcuugcucuggaaaggaaauugaagaagaugcucggaccaucagcgguugagauaggcaauggguguuucgaaacaaaacacaagugcaaccagaccugccuggaucggaucgcagccggaacuuuugacgcuggugaguucaguuuacccaccuuugauagccugaauauuacagccgcaucccuaaacgacgauggccucgacaaucacaccauccugcuuuauuacucuacugccgcuagcucauuggccgugacacugaugaucgcaauuuucgucguguauauggucagucgugauaacguguccuguagcauaugccucuga

SEQ ID NO: 149465 - RNA, 1758 nt, Artificial Sequence; identical to SEQ ID NO: 148624
  derived and/or modified sequence opt3 from hemagglutinin__InfluenzaB__AGX20943

SEQ ID NO: 149466 - RNA, 1758 nt, Artificial Sequence; identical to SEQ ID NO: 148624
  derived and/or modified sequence opt3 from hemagglutinin__InfluenzaB__AGX20954

SEQ ID NO: 149467 - RNA, 1758 nt, Artificial Sequence; identical to SEQ ID NO: 148624
  derived and/or modified sequence opt3 from hemagglutinin__InfluenzaB__AGX20965

SEQ ID NO: 149468 - RNA, 1758 nt, Artificial Sequence
  derived and/or modified sequence opt3 from hemagglutinin__InfluenzaB__AGX20976
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauggcgaaauccuggaguuggaugaaaagguggacgaccuaagagcagauacgaucucgucucaaauugagcuggccguacuccuguccaacgaaggaaucauuaauucagaggacgagcaccuucuggcuuuggaaaggaaacucaagaagaugcugggcccuagugcgguugagauagggaacggauguuucgaaacaaaacauaagugcaaucagaccugcuuagaucggaucgcagccgguacuuuugacgcuggcgaguucagccugcccaccuuugauucccuaaacauuacagccgcaucucucaaugacgaugggcuggacaaccacaccauccuuuuguauuacagcacugccgcuucaagucuggccgugacacucaugaucgcaauuuucgucguguauauggucucccgugauaaugugagcuguucuauaugccuguga

SEQ ID NO: 149469 - RNA, 1758 nt, Artificial Sequence; identical to SEQ ID NO: 148624
  derived and/or modified sequence opt3 from hemagglutinin__InfluenzaB__AGX20987

SEQ ID NO: 149470 - RNA, 1758 nt, Artificial Sequence; identical to SEQ ID NO: 148699
  derived and/or modified sequence opt3 from hemagglutinin__InfluenzaB__AGX20998

SEQ ID NO: 149471 - RNA, 1758 nt, Artificial Sequence
  derived and/or modified sequence opt3 from hemagglutinin__InfluenzaB__AGX21009
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggaucggaucgcagccggaacuuuugacgcuggugaguucagcuuaccaaccuuugauucccugaauauuacagccgcaucucuaaacgacgauggccucgacaaucacaccauccugcuuuauuacagcacugccgcuucaaguuuggccgugacacugaugaucgcaauuuucgucguguauaugauaucccgugauaacgucagcuguucuaucugccucuga

SEQ ID NO: 149472 - RNA, 1758 nt, Artificial Sequence
  derived and/or modified sequence opt3 from hemagglutinin__InfluenzaB__AGX21020
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccgagccucagaaguuuacaucuagcgccaacggagugaccacgcacuacgucucccaaauuggcgguuucccaaaccagaccgaagacgggggacugccccagucaggccgcaucguuguggauuauaugguacagaaaaguggcaagacagggacuauuaccuaccaaagaggaauccucuuaccucagaaaguguggugcgcgagcgguaggucuaaggucaucaaaggcucccugccacuuauuggggaggcagacuguuugcaugagaaguauggaggccugaauaaaucaaagcccuacuacacaggugaacacgccaaggcuauagggaacugcccgaucugggugaaaacuccucuaaagcucgccaauggcaccaaauaucggcccccagcaaagcugcuuaaagagcgcggauuuuucggcgcuauugccggguuucuggaaggagguugggagggcaugaucgcgggguggcauggauacacaagccacggcgcccacgguguugcaguggcugccgauuugaagaguacccaggaagcuauaaacaagauuacuaaaaaucucaacucucuguccgaguuagaggucaagaaucugcagcgacucagcggggccauggacgaacuucauaacgagauccuggaauuggaugagaaaguggacgaccuaagagcagauacgaucucgucucaaauugaacuggccguacuccuguccaaugagggcaucauuaacucagaggacgaacaccuucuggcuuuggagaggaagcucaaaaagaugcugggaccuagugcgguugaaauaggcaauggguguuucgagacaaagcauaaaugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 149473 - RNA, 1758 nt, Artificial Sequence; identical to SEQ ID NO: 148699
  derived and/or modified sequence opt3 from hemagglutinin__InfluenzaB__AGX21031

SEQ ID NO: 149474 - RNA, 1758 nt, Artificial Sequence
  derived and/or modified sequence opt3 from hemagglutinin__InfluenzaB__AGX21042
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaauacugagaacgccccagggggacccuauaagaucggcaccucaggcagcugcccuaauguuacaaacgggaauggauucuuugcaaccauggccugggcugugccgaaaaacgacaagaauaaaacggcaacuaacccacucacaauugaaguccccuacaucuguaccgagggugaggaucagauaacuguguggggcuuccacagugacaaugaaacacagauggccaagcuguauggggauuccaagccucagaaauuuaccucuagcgcuaacggagugacgacccacuacgucucccaaauuggcgguuucccaaaccagacagaggacgggggacugccccagucaggccgcaucguuguggauuauaugguacagaagaguggcaaaacugggaccauuacauaccaaagaggaauccucuuaccucagaagguguggugcgccagcgguaggucuaaagucaucaagggcucccugccacuuauuggggaagcggacuguuugcaugagaaauauggaggccugaauaagucaaagcccuacuacacuggugagcacgcaaaagccauagggaacugcccgaucugggugaagaccccucuaaaacucgcuaauggcacaaaguaucggcccccagccaaacugcuuaaggaacgcggauuuuucggcgcaauugcuggguuucuggagggagguugggaaggcaugaucgccggguggcauggauacaccagccacggcgcgcacgguguugccguggcagcugauuugaagaguacucaggaggccauaaacaaaauuacgaagaaucucaacucucuguccgaauuagaggucaaaaaucugcagcgacucagcggggcuauggacgagcuucauaacgaaauccuggaguuggaugaaaagguggacgaccuaagagccgauacaaucucgucucaaauugagcuggcaguacuccuguccaaugaaggcaucauuaacucagaggacgagcaccuucuggccuuggaaaggaaacucaagaagaugcugggaccuagugcuguugagauaggcaauggguguuucgaaaccaaacauaagugcaaccagacuugcuuagaucggaucgcggcaggaaccuuugacgccggugaguucagccugcccacauuugauucccuaaauauuaccgcugccucucucaacgacgauggccuggacaaucacacuauccuuuuguauuacagcacagcagccucaagucuggcugugacgcucaugaucgccauuuucgucguguauauggucucccgugauaacgugagcuguucuauaugccuguga

SEQ ID NO: 149475 - RNA, 1758 nt, Artificial Sequence; identical to SEQ ID NO: 148661
  derived and/or modified sequence opt3 from hemagglutinin__InfluenzaB__AGX21053

SEQ ID NO: 149476 - RNA, 1758 nt, Artificial Sequence; identical to SEQ ID NO: 148624
  derived and/or modified sequence opt3 from hemagglutinin__InfluenzaB__AGX21064

SEQ ID NO: 149477 - RNA, 1758 nt, Artificial Sequence; identical to SEQ ID NO: 148661
  derived and/or modified sequence opt3 from hemagglutinin__InfluenzaB__AGX21075

SEQ ID NO: 149478 - RNA, 1758 nt, Artificial Sequence; identical to SEQ ID NO: 148661
  derived and/or modified sequence opt3 from hemagglutinin__InfluenzaB__AGX21084

SEQ ID NO: 149479 - RNA, 1758 nt, Artificial Sequence; identical to SEQ ID NO: 148661
  derived and/or modified sequence opt3 from hemagglutinin__InfluenzaB__AGX21095

SEQ ID NO: 149480 - RNA, 1758 nt, Artificial Sequence
  derived and/or modified sequence opt3 from hemagglutinin__InfluenzaB__AGX21106
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaagcucagauggccaagcucuauggggauuccaagccacagaaauuuacuucuagcgcgaacggagugacaacccacuacgucucccaaauuggcgguuuccccaaccagacggaggacgggggacugccucagucaggccgcaucguuguggauuauaugguacagaagaguggcaaaaccgggacaauuacuuaccaaagaggaauccugcucccacagaagguguggugcgcaagcgguaggucuaaagucaucaagggcuccuuaccccugauuggggaagccgacugucuucaugagaaauauggaggcuugaauaagucaaagccguacuacaccggugagcacgcuaaagccauagggaacugcccuaucugggugaagacaccccugaaacuagcaaauggcacuaaguaucggccuccagcuaaacuccugaaggaacgcggauuuuucggcgccauugcgggguuucuugagggagguugggaaggcaugaucgccggguggcauggauacaccagccacggcgcacacgguguugcuguggccgcugaucugaagaguacacaggaggccauaaacaaaauuaccaagaauuugaacucucucuccgaacuggaggucaaaaauuuacagcgacugagcggggcaauggacgagcuccauaacgaaauccuugagcuggaugaaaagguggacgacuugagagccgauacuaucucgucucaaauugagcuagcuguacugcucuccaaugaaggcaucauuaacucagaggacgagcaucugcuugcgcuggaaaggaaauugaagaagaugcucggacccagugcaguugagauaggcaauggguguuucgaaacgaaacacaagugcaaccagacaugccuggaucggaucgccgcuggaaccuuugacgccggugaguucagcuuaccaacuuuugauucccugaauauuaccgcagccucucuaaacgacgauggccucgacaaucacacaauccugcuuuauuacagcaccgcugccucaaguuuggcagugacucugaugaucgcgauuuucgucguguauauggucucccgugauaacgugagcuguucuauaugccucuga

SEQ ID NO: 149481 - RNA, 1758 nt, Artificial Sequence; identical to SEQ ID NO: 148624
  derived and/or modified sequence opt3 from hemagglutinin__InfluenzaB__AGX21117

SEQ ID NO: 149482 - RNA, 1758 nt, Artificial Sequence; identical to SEQ ID NO: 149474
  derived and/or modified sequence opt3 from hemagglutinin__InfluenzaB__AGX21128

SEQ ID NO: 149483 - RNA, 1758 nt, Artificial Sequence
  derived and/or modified sequence opt3 from hemagglutinin__InfluenzaB__AGX21139
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgacuuccccaaccagaccgaggauggugggcugccucagucaggacgcaucguuguggacuauaugguacagaagaguggcaaaacaggcacuauuaccuaccaaagagggauccugcucccacagaagguguggugcgcgagcggaaggucuaaagucaucaaggguuccuuaccccugauuggcgaagcagauugucuucaugagaaauaugggggauugaauaagucaaagccguacuacacaggcgagcacgccaaagcuauagguaacugcccuaucugggugaagacuccccugaaacuagccaaugggaccaaguaucggccuccagcaaaacuccugaaggaacgcggcuuuuucggagcuauugccggcuuucuugaagggggaugggaggguaugaucgcgggcuggcauggguacacaagccacggagcccacggcguugcaguggcugccgaccugaagaguacccaggaggcuauaaacaaaauuacuaagaauuugaacucucucuccgaacuggaggucaaaaauuuacagcgacugagcggugccauggaugagcuccauaacgaaauccuugagcuggacgaaaagguggacgauuugagagcagacacgaucucgucucaaauugagcuagccguacugcucuccaaugaagggaucauuaacucagaggaugagcaucugcuugcucuggaaaggaaauugaagaagaugcucggccccagugcgguugagauaggaaauggcuguuucgaaacaaaacacaagugcaaccagaccugccuggaccggaucgcagccgggacuuuugaugcuggagaguucagcuuaccaaccuuugacucccugaauauuacagccgcaucucuaaacgaugacggucucgauaaucacaccauccugcuuuauuacagcacugccgcuucaaguuuggccgugacacugaugaucgcaauuuucgucguguauauggucucccgugacaacgugagcuguucuauaugccucuga

SEQ ID NO: 149484 - RNA, 1758 nt, Artificial Sequence; identical to SEQ ID NO: 148699
  derived and/or modified sequence opt3 from hemagglutinin__InfluenzaB__AGX21150

SEQ ID NO: 149485 - RNA, 1758 nt, Artificial Sequence; identical to SEQ ID NO: 148624
  derived and/or modified sequence opt3 from hemagglutinin__InfluenzaB__AGX21161

SEQ ID NO: 149486 - RNA, 1758 nt, Artificial Sequence; identical to SEQ ID NO: 148699
  derived and/or modified sequence opt3 from hemagglutinin__InfluenzaB__AGX21172

SEQ ID NO: 149487 - RNA, 1758 nt, Artificial Sequence; identical to SEQ ID NO: 148661
  derived and/or modified sequence opt3 from hemagglutinin__InfluenzaB__AGX21183

SEQ ID NO: 149488 - RNA, 1758 nt, Artificial Sequence; identical to SEQ ID NO: 148699
  derived and/or modified sequence opt3 from hemagglutinin__InfluenzaB__AGX21194

SEQ ID NO: 149489 - RNA, 1758 nt, Artificial Sequence
  derived and/or modified sequence opt3 from hemagglutinin__InfluenzaB__AGX21205
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccaagaacgcaccagggggacccuauaaaauuggcacuucaggcagcugcccuaauaucaccaacgggaauggauucuuugccacaauggcuugggcaguaccaaagaacgacaaaaauaagaccgccacgaacccgcucacuauagagguucccuacauuuguacagaaggugaggaucagaucaccguguggggcuuccacagugacaaugagacucagauggcuaagcuguauggggauuccaaaccucagaaguuuacaucuagcgccaacggagucaccacgcacuacgugucccaaauuggcgguuucccaaaccagaccgaagacgggggacugccccagucaggccgcaucguggucgauuauaugguucagaaaaguggcaagacagggacuaucaccuaccaaagagguauucucuuaccucagaaaguguggugcgcgagcggaaggucuaagguaauaaaaggcucccugccacuuaucggggaggcagacuguuugcaugaaaaguauggaggccugaauaagucaaaacccuacuacacaggugagcacgccaaggcuauugggaacugcccgaucugggugaaaacuccucuaaagcucgccaauggcaccaaauaucggcccccagcaaagcugcuuaaggagcgcggauuuuucggcgcuauagccggguuucuggaaggagguugggagggcaugauugcgggguggcauggauacacaagccacggcgcccacggugucgcaguggcugccgauuugaaaaguacccaggaagcuaucaacaagaucacuaaaaaucucaacucucuguccgaguuagaaguuaagaaucugcagcgacucagcggggccauggacgagcuucauaacgagauucuggaauuggaugagaaaguggacgaccuaagagcagauacgaucucgucucaaauugaacuggccguccuccuguccaaugagggcauaaucaacucagaagacgagcaccuucuggcuuuggagaggaagcucaagaaaaugcugggaccuagugcgguggaaauuggcaauggguguuucgagacaaagcauaaaugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgugauaacgugagcuguucuauuugccuguga

SEQ ID NO: 149490 - RNA, 1758 nt, Artificial Sequence; identical to SEQ ID NO: 148661
  derived and/or modified sequence opt3 from hemagglutinin__InfluenzaB__AGX21216

SEQ ID NO: 149491 - RNA, 1758 nt, Artificial Sequence; identical to SEQ ID NO: 148624
  derived and/or modified sequence opt3 from hemagglutinin__InfluenzaB__AGX21227

SEQ ID NO: 149492 - RNA, 1758 nt, Artificial Sequence
  derived and/or modified sequence opt3 from hemagglutinin__InfluenzaB__AGX21238
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccaaagaacgacaagaauaaaaccgccacgaacccgcucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgaaugguaggagcaaagucaucaagggcucucugccacuuauuggggaagcagacuguuugcaugagaaauauggaggccugaacaaguccaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaucacacggcgcccacgguguugcaguggcugccgauuugaaaagcacccaggaggcuauaaauaaaauuacuaagaaccucaauagucugucugaauuagaggucaaaaaccugcagcgacucuccggggccauggacgagcuucauaaugaaauccuggaguuggaugaaaagguggacgaccuaagagcagauacgaucagcucgcaaauugagcuggccguacuccugucuaacgaaggcaucauuaauuccgaggacgagcaccuucuggcuuuggaaaggaaacucaagaagaugcugggaccuucagcgguugagauaggcaacggguguuucgaaacaaaacauaagugcaaucagaccugcuuagaucggaucgcagccggaacuuuugacgcuggugaguucagucugcccaccuuugauagccuaaacauuacagccgcaucccucaaugacgauggccuggacaaccacaccauccuuuuguauuacucuacugccgcuagcucacuggccgugacacucaugaucgcaauuuucgucguguauaugauaagucgugauaacgucuccuguagcaucugccuguga

SEQ ID NO: 149493 - RNA, 1758 nt, Artificial Sequence; identical to SEQ ID NO: 148699
  derived and/or modified sequence opt3 from hemagglutinin__InfluenzaB__AGX21249

SEQ ID NO: 149494 - RNA, 1758 nt, Artificial Sequence
  derived and/or modified sequence opt3 from hemagglutinin__InfluenzaB__AGX21260
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugcccaaaaacgacaagaauaaaaccgccacgaacccgcucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaggguguggugcgcgagcggucggucuaaggucaucaaaggcucccugccacuuauuggggaagcagacuguuugcaugagaaguauggaggccugaauaaaucaaagcccuacuacacaggugagcacgccaaggcuauagggaacugcccgaucugggugaaaacuccucuaaagcucgccaauggcaccaaauaucgcccaccagcaaagcugcuuaaagaacgaggauuuuucggcgcuauugccggguuucuggagggagguugggaaggcaugaucgcgggguggcauggauacacaagccacggcgcccacgguguugcaguggcugccgauuugaagaguacccaggaggcuauaaacaagauuacuaaaaaucucaacucucuguccgaauuagaggucaagaaucugcagagacucagcggggccauggacgagcuucauaacgaaauccuggaguuggaugaaaaaguggacgaccuaagggcagauacgaucucgucucaaauugagcuggccguacuccuguccaaugaaggcaucauuaacucagaggacgagcaccuucuggcuuuggaacggaagcucaaaaagaugcugggaccuagugcgguugagauaggcaauggguguuucgaaacaaagcauaaaugcaaccagaccugcuuagaucguaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgcgauaacgugagcuguucuauaugccuguga

SEQ ID NO: 149495 - RNA, 1758 nt, Artificial Sequence; identical to SEQ ID NO: 148624
  derived and/or modified sequence opt3 from hemagglutinin__InfluenzaB__AGX21271

SEQ ID NO: 149496 - RNA, 1758 nt, Artificial Sequence
  derived and/or modified sequence opt3 from hemagglutinin__InfluenzaB__AGX21282
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccaguccaacaaagagccauuucgccaaucugaaagguaccgaaacuaggggcaaguuguguccgaaaugcuuaaacuguacagaucuggacguggcgcuagggcggcccaagugcaccggaaagauuccuuccgcucgcguuucuauccuccacgaggugcgaccagucacgucgggcuguuuucccauaaugcaugaucguacuaaaaucagacaacugccuaaucuucugagggguuacgaacacauucgguugucaacccauaacgugaucaaugccaagaacgcaccagggggacccuauaaaauuggcacaagcggcaguugcccuaauaucacuaacgggaauggauucuuugccaccauggcuugggcaguaccaaagaacgacaaaaauaagacagccaccaacccgcucacgauagagguucccuacauuuguacugaaggugaggaucagaucacaguguggggcuuccacuccgacaaugagacccagauggcuaagcuguauggggauucuaaaccucagaaguuuacuagcuccgccaacggagucacaacccacuacgugucacaaauuggcgguuucccaaaccagacggaagacgggggacugccccagaguggccgcaucguggucgauuauaugguucagaaaagcggcaagaccgggacaaucacuuaccaaagagguauucucuuaccucagaaaguguggugcgcgucuggaagguccaagguaauaaaaggcucacugccacuuaucggggaggcagacuguuugcaugaaaaguauggaggccugaauaagagcaaacccuacuacaccggugagcacgccaaggcuauugggaacugcccgaucugggugaaaacaccucuaaagcucgccaauggcacuaaauaucggcccccagcaaagcugcuuaaggagcgcggauuuuucggcgcuauagccggguuucuggaaggagguugggagggcaugauugcgggguggcauggauacaccagucacggcgcccacggugucgcaguggcugccgauuugaaaucuacacaggaagcuaucaacaagaucaccaaaaaucucaacucccugagcgaguuagaaguuaagaaucugcagcgacucucgggggccauggacgagcuucauaacgagauucuggaauuggaugagaaaguggacgaccuaagagcagauacuaucucuucccaaauugaacuggccguccuccugucaaaugagggcauaaucaacagugaagacgagcaccuucuggcuuuggagaggaagcucaagaaaaugcugggaccuagcgcgguggaaauuggcaauggguguuucgagacgaagcauaaaugcaaccagacaugcuuagaucggaucgcagccggaaccuuugacgcuggugaguucucccugcccacuuuugauucucuaaauaucaccgccgcaagccucaacgacgauggccuggacaaucacacaauucuuuuguauuacucaaccgccgcuaguucccuggccguaacucucaugauagcaaucuucguuguguauauggucagccgugauaacgugucuuguucaauuugccuguga

SEQ ID NO: 149497 - RNA, 1758 nt, Artificial Sequence; identical to SEQ ID NO: 148661
  derived and/or modified sequence opt3 from hemagglutinin__InfluenzaB__AGX21293

SEQ ID NO: 149498 - RNA, 1758 nt, Artificial Sequence; identical to SEQ ID NO: 148699
  derived and/or modified sequence opt3 from hemagglutinin__InfluenzaB__AGX21304

SEQ ID NO: 149499 - RNA, 1758 nt, Artificial Sequence; identical to SEQ ID NO: 148661
  derived and/or modified sequence opt3 from hemagglutinin__InfluenzaB__AGX21315

SEQ ID NO: 149500 - RNA, 1758 nt, Artificial Sequence; identical to SEQ ID NO: 148624
  derived and/or modified sequence opt3 from hemagglutinin__InfluenzaB__AGX21326

SEQ ID NO: 149501 - RNA, 1758 nt, Artificial Sequence
  derived and/or modified sequence opt3 from hemagglutinin__InfluenzaB__AGX21337
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaggaaacucagauggcuaagcucuauggggauuccaaaccacagaaguuuacaucuagcgccaauggagugaccacgcacuacgucucccaaauuggcgguuuccccaaccagaccgaggacgggggacugccucagucaggccgcaucguuguggauuauaugguacagaaaaguggcaagacagggacuauuaccuaccaaagaggaauccugcucccacagaaaguguggugcgcgagcgguaggucuaaggucaucaaaggcuccuuaccccugauuggggaagcagacugucuucaugagaaguauggaggcuugaacaagucaaaaccguacuacacaggugagcacgccaaggcuauagggaauugcccuaucugggugaaaacuccccugaagcuagccaacggcaccaaauaucggccuccagcaaagcuccugaaggaacgcggauuuuucggcgcuauugccggguuucuugagggagguugggaaggcaugaucgcgggguggcauggauacacaagccacggcgcccacgguguugcaguggcugccgaucugaaaaguacccaggaggcuauaaauaagauuacuaaaaaccuuaauucucucuccgaacuggaggucaagaacuuacagcgacugagcggggccauggacgagcuccauaaugaaauccuugagcuggaugaaaaaguggacgacuugagagcagauacgaucucgucucaaauugagcuagccguacugcucuccaacgaaggcaucauuaauucagaggacgagcaccuguuggcucuggaaaggaaguugaagaaaaugcucggacccagugcgguugagauaggcaacggguguuucgaaacaaagcauaaaugcaaucagaccugccuggaucggaucgcagccggaacuuuugacgcuggugaguucagcuuaccaaccuuugauucccugaacauuacagccgcaucucuaaaugacgauggccucgacaaccacaccauccugcuuuauuacagcacugccgcuucaaguuuggccgugacacugaugaucgcaauuuucgucguguauauggucucccgugauaaugugagcuguucuauaugccucuga

SEQ ID NO: 149502 - RNA, 1758 nt, Artificial Sequence; identical to SEQ ID NO: 148661
  derived and/or modified sequence opt3 from hemagglutinin__InfluenzaB__AGX21348

SEQ ID NO: 149503 - RNA, 1758 nt, Artificial Sequence; identical to SEQ ID NO: 148661
  derived and/or modified sequence opt3 from hemagglutinin__InfluenzaB__AGX21359

SEQ ID NO: 149504 - RNA, 1758 nt, Artificial Sequence
  derived and/or modified sequence opt3 from hemagglutinin__InfluenzaB__AGX21370
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcaugggaaagaucccaagcgcucgcguguccauucuacacgagguccgacccgugacgucuggcuguuuuccuaucaugcaugaucguacuaaaauaagacaacucccaaaucugcuuagggguuacgaacacauccggcugucgacccauaacguaauuaaugccgagaacgcacccgggggaccuuauaagaucggcacaucaggcagcugcccaaauguuacuaacgggaauggauucuuugccaccauggcuugggcagugccgaaaaacgacaagaauaaaacagccaccaaccccuugacgauugaagucccuuacaucuguacugagggugaggaucagauaacaguguggggcuuccacagugacaaugaaacccagauggcuaagcucuauggggauuccaagccacagaaauuuacuucuagcgccaacggagugacaacccacuacgucucccaaauuggcgguuuccccaaccagacggaggacgggggacugccucagucaggccgcaucguuguggauuauaugguacagaagaguggcaaaaccgggacaauuacuuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacaccggugagcacgccaaagcuauagggaacugcccuaucugggugaagacaccccugaaacuagccaauggcacuaaguaucggccuccagcaaaacuccugaaggaacgcggauuuuucggcgcuauugccggguuucuugagggagguugggaaggcaugaucgcgggguggcauggauacaccagccacggcgcccacgguguugcaguggcugccgaucugaagaguacacaggaggcuauaaacaaaauuaccaagaauuugaacucucucuccgaacuggaggucaaaaauuuacagcgacugagcggggccauggacgagcuccauaacgaaauccuugagcuggaugaaaagguggacgacuugagagcagauacuaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacgaaacacaagugcaaccagacaugccuggaucggaucgcagccggaaccuuugacgcuggugaguucagcuuaccaacuuuugauucccugaauauuaccgccgcaucucuaaacgacgauggccucgacaaucacacaauccugcuuuauuacagcaccgccgcuucaaguuuggccgugacucugaugaucgcaauuuucgucguguauauggucucccgugauaacgugagcuguucuauaugccucuga

SEQ ID NO: 149505 - RNA, 1758 nt, Artificial Sequence
  derived and/or modified sequence opt3 from hemagglutinin__InfluenzaB__AGX21381
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacauuucccaaaucggcgguuucccaaaccagaccgaggacgggggacugccccagucaggccgcaucgugguggauuauaugguccagaagaguggcaaaacagggacuauuaccuaccaaagaggaauacucuuaccucagaagguuuggugcgcgagcgguaggucuaaagugaucaagggcucccugccacuuauuggggaagcagacuguuugcaugagaaauauggaggccugaauaagucaaagcccuacuacacaggugagcacgccaaagcuaucgggaacugcccgauauggguaaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguggcagucgcugccgauuugaagaguacccaggaggcuaucaacaaaauuacuaagaaucucaacucucuguccgaauuagaggugaaaaaucugcagcgacucagcggggccauggacgagcuucauaacgaaauccuggaguuggaugaaaagguugacgaccuaagagcagauacgauuucgucucaaauagagcuggccgugcuccuguccaaugaaggcaucauuaacucagaggacgagcaccuucuggcuuuggaaaggaaacucaagaagaugcugggaccuagugcggucgagaucggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauacuuuuguauuacagcacugccgcuucaagucuggccgugacacucaugaucgcaauuuucguaguuuauauggugucccgugauaacgucagcuguucuaucugccuguga

SEQ ID NO: 149506 - RNA, 1758 nt, Artificial Sequence
  derived and/or modified sequence opt3 from hemagglutinin__InfluenzaB__AGX21392
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaagcucagauggccaagcuguauggggauuccaagccucagaaauuuacuucuagcgcgaacggagucacaacccacuacgugucccaaauuggcgguuucccaaaccagacggaggacgggggacugccccagucaggccgcaucguggucgauuauaugguucagaagaguggcaaaaccgggacaaucacuuaccaaagagguauucucuuaccucagaagguguggugcgcaagcggaaggucuaaaguaauaaagggcucccugccacuuaucggggaagccgacuguuugcaugagaaauauggaggccugaauaagucaaagcccuacuacaccggugagcacgcuaaagccauugggaacugcccgaucugggugaagacaccucuaaaacucgcaaauggcacuaaguaucggcccccagcuaaacugcuuaaggaacgcggauuuuucggcgccauagcgggguuucuggagggagguugggaaggcaugauugccggguggcauggauacaccagccacggcgcacacggugucgcuguggccgcugauuugaagaguacacaggaggccaucaacaaaaucaccaagaaucucaacucucuguccgaauuagagguuaaaaaucugcagcgacucagcggggcaauggacgagcuucauaacgaaauucuggaguuggaugaaaagguggacgaccuaagagccgauacuaucucgucucaaauugagcuggcuguccuccuguccaaugaaggcauaaucaacucagaggacgagcaccuucuggcguuggaaaggaaacucaagaagaugcugggaccuagugcaguggagauuggcaauggguguuucgaaacgaaacauaagugcaaccagacaugcuuagaucggaucgccgcuggaaccuuugacgccggugaguucagccugcccacuuuugauucccuaaauaucaccgcagccucucucaacgacgauggccuggacaaucacacaauucuuuuguauuacagcaccgcugccucaagucuggcaguaacucucaugauagcgaucuucguuguguauauggucucccgugauaacgugagcuguucuauuugccuguga

SEQ ID NO: 149507 - RNA, 1758 nt, Artificial Sequence
  derived and/or modified sequence opt3 from hemagglutinin__InfluenzaB__AGX21403
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccugaaucggaucgcagccggaacuuuugaugcuggugaguucagcuuaccaaccuuugacucccugaacauuacagccgcaucucuaaaugaugacggccucgauaaccacaccauccugcuuuauuacagcacugccgcuucaaguuuggccgugacacugaugaucgcaauuuucgucguguauauggucucccgugacaacgugagcuguucuauaugccucuga

SEQ ID NO: 149508 - RNA, 1758 nt, Artificial Sequence
  derived and/or modified sequence opt3 from hemagglutinin__InfluenzaB__AGX21414
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacggaucccuugacuauugaagucccuuacaucuguacagagggugaggaccagauaaccguguggggcuuccacagugauaacgaaacucagauggcuaagcucuauggggacuccaagccacagaaauuuacaucuagcuccaauggagugaccacgcacuacgucucacaaauuggcgguuuccccaaccagaccgaggaugggggacugccucagaguggccgcaucguuguggacuauaugguacagaaguccggcaaaacagggacuauuaccuaccaaagaggaauccugcucccacagaagguguggugcgccucugguagguccaaagucaucaagggcucauuaccccugauuggggaagcggauugucuucaugagaaauauggaggcuugaacaagagcaagccguacuacacaggugagcacgcaaaagccauagggaauugcccuaucugggugaagacuccccugaaacuagcuaacggcaccaaguaucggccuccagccaaacuccugaaggaacgcggauuuuucggcgcaauugcuggguuucuugagggagguugggaaggcaugaucgccggguggcauggauacacaagucacggcgcgcacgguguugccguggcagcugaccugaagucuacccaggaggccauaaauaaaauuacuaagaacuugaauagccucagcgaacuggaggucaaaaacuuacagcgacugucgggggcuauggaugagcuccauaaugaaauccuugagcuggacgaaaagguggacgauuugagagccgacacgaucucuucccaaauugagcuagcaguacugcucucaaacgaaggcaucauuaauagugaggaugagcaucugcuugcccuggaaaggaaauugaagaagaugcucggacccagcgcuguugagauaggcaacggguguuucgaaacaaaacacaagugcaaucagaccugccuggaccggaucgcggcaggaacuuuugaugccggugaguucuccuuaccaaccuuugacucucugaacauuacagcugccagccuaaaugaugacggccucgauaaccacaccauccugcuuuauuacucaacugcagccaguuccuuggcugugacacugaugaucgccauuuucgucguguauauggucagccgugacaaugugucuuguucaauaugccucuga

SEQ ID NO: 149509 - RNA, 1758 nt, Artificial Sequence; identical to SEQ ID NO: 148624
  derived and/or modified sequence opt3 from hemagglutinin__InfluenzaB__AGX21425

SEQ ID NO: 149510 - RNA, 1758 nt, Artificial Sequence
  derived and/or modified sequence opt3 from hemagglutinin__InfluenzaB__AGX21436
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugguucagaagaguggcaaaacagggacuaucaccuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacacaggugagcacgccaaagcuauugggaacugcccgaucugggugaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacggugucgcaguggcugccgauuugaagaguacccaggaggcuaucaacaaaaucacuaagaaucucaacucucuguccgaauuagagguuaaaaaucugcagcgacucagcggggccauggacgagcuucauaacgaaauucuggaguuggaugaaaagguggacgaccuaagagcagauacgaucucgucucaaauugagcuggccguccuccuguccaaugaaggcauaaucaacucagaggacgagcaccuucuggcuuuggaaaggaaacucaagaagaugcugggaccuagugcgguggagauuggcaauggguguuucgaaacaaaacauaagugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacuguagccucaagucuggcuguuacacucaugauagccaucuucguggucuauauggugucccgugauaacgucagcuguucuauuugccuguga

SEQ ID NO: 149511 - RNA, 1758 nt, Artificial Sequence; identical to SEQ ID NO: 148699
  derived and/or modified sequence opt3 from hemagglutinin__InfluenzaB__AGX21447

SEQ ID NO: 149512 - RNA, 1758 nt, Artificial Sequence; identical to SEQ ID NO: 148624
  derived and/or modified sequence opt3 from hemagglutinin__InfluenzaB__AGX21458

SEQ ID NO: 149513 - RNA, 1758 nt, Artificial Sequence; identical to SEQ ID NO: 148624
  derived and/or modified sequence opt3 from hemagglutinin__InfluenzaB__AGX21469

SEQ ID NO: 149514 - RNA, 1758 nt, Artificial Sequence
  derived and/or modified sequence opt3 from hemagglutinin__InfluenzaB__AGX21480
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgaagacggccuggauaaucacaccauccuuuuguauuacagcacugccgcuucaagucuggccgugacacucaugaucgcaauuuucgucguguauauggucucccgugacaacgugagcuguucuauaugccuguga

SEQ ID NO: 149515 - RNA, 1758 nt, Artificial Sequence; identical to SEQ ID NO: 148699
  derived and/or modified sequence opt3 from hemagglutinin__InfluenzaB__AGX21491

SEQ ID NO: 149516 - RNA, 1758 nt, Artificial Sequence; identical to SEQ ID NO: 148699
  derived and/or modified sequence opt3 from hemagglutinin__InfluenzaB__AGX21502

SEQ ID NO: 149517 - RNA, 1758 nt, Artificial Sequence; identical to SEQ ID NO: 148624
  derived and/or modified sequence opt3 from hemagglutinin__InfluenzaB__AGX21513

SEQ ID NO: 149518 - RNA, 1758 nt, Artificial Sequence; identical to SEQ ID NO: 148661
  derived and/or modified sequence opt3 from hemagglutinin__InfluenzaB__AGX21524

SEQ ID NO: 149519 - RNA, 1758 nt, Artificial Sequence
  derived and/or modified sequence opt3 from hemagglutinin__InfluenzaB__AGX21535
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccaaagaacgacaagaauaaaaccgccacgaacccgcucacuauagaaguucccuacauuuguacagagggugaggaucagaucaccguguggggcuuccacagugacuccgaaacucagauggcuaagcuguauggggauucuaagccucagaaauuuacaagcuccgccaauggagucaccacgcacuacgugucacaaauuggcgguuucccaaaccagaccgaggacgggggacugccccagaguggccgcaucguggucgauuauaugguucagaaaagcggcaaaacagggacuaucaccuaccaaagagguauucucuuaccucagaagguguggugcgcgucuggaagguccaaaguaauaaagggcucacugccacuuaucggggaagcagacuguuugcaugagaaauauggaggccugaacaagagcaagcccuacuacacaggugagcacgccaaagcuauugggaauugcccgaucugggugaagacuccucuaaaacucgccaacggcaccaaguaucggcccccagcaaaacugcuuaaggaacgcggauuuuucggcgcuauagccggguuucuggagggagguugggaaggcaugauugcgggguggcauggauacacaagucacggcgcccacggugucgcaguggcugccgauuugaagucuacccaggaggcuaucaauaaaaucacuaagaaccucaauucccugagcgaauuagagguuaaaaaccugcagcgacucucgggggccauggacgagcuucauaaugaaauucuggaguuggaugaaaagguggacgaccuaagagcagauacgaucucuucccaaauugagcuggccguccuccugucaaacgaaggcauaaucaauagugaggacgagcaccuucuggcuuuggaaaggaaacucaagaagaugcugggaccuagcgcgguggagauuggcaacggguguuucgaaacaaaacauaagugcaaucagaccugcuuagaucggaucgcagccggaacuuuugacgcuggugaguucucccugcccaccuuugauucucuaaacaucacagccgcaagccucaaugacgauggccuggacaaccacaccauucuuuuguauuacucaacugccgcuaguucccuggccguaacacucaugauagcaaucuucguuguguauauggucagccgugauaaugugucuuguucaauuugccuguga

SEQ ID NO: 149520 - RNA, 1758 nt, Artificial Sequence; identical to SEQ ID NO: 148661
  derived and/or modified sequence opt3 from hemagglutinin__InfluenzaB__AGX21546

SEQ ID NO: 149521 - RNA, 1758 nt, Artificial Sequence
  derived and/or modified sequence opt3 from hemagglutinin__InfluenzaB__AGX21557
augaaggccaucauugugcugcucauggucguuaccagcaacgcugacagaauaugcacaggcaucacuuccucuaauucaccccacgugguaaaaacggcaacccagggggaggugaacgucacaggagugauuacucuuaccacaaccccuacuaagagucauuucgccaaucugaaagguacagaaaccaggggcaaguuguguccaaaaugcuuaaacuguacggaucuggacguugcgcuagggcggccgaagugcacuggaaagauccccagcgcucgcguguccauucuccacgagguccgaccugugaccucuggcuguuuuccaaucaugcaugaucguacaaaaauaagacaacugcccaaucuucugagggguuacgaacacauccgguugucgacucauaacguaauuaaugccgagaacgcaccugggggaccauauaagaucggcaccucaggcagcugccccaauguuacaaacgggaauggauucuuugccaccauggcuugggcagugccuaaaaacgacaagaauaaaacggccacuaacccacucacaauugaagucccguacaucuguaccgagggugaggaucagauaacuguguggggcuuccacagugacaaugaaacacagauggcuaagcuguauggggauuccaagccccagaaauuuaccucuagcgccaacggagugacgacccacuacgucucccaaauuggcgguuucccuaaccagacagaggacgggggacugccacagucaggccgcaucguuguggauuauaugguacagaagaguggcaaaacugggaccauuacauaccaaagaggaauccucuuaccccagaagguguggugcgcgagcgguaggucuaaagucaucaagggcucccugccucuuauuggggaagcagacuguuugcaugagaaauauggaggccugaauaagucaaagccauacuacacuggugagcacgccaaagcuauagggaacugccccaucugggugaagaccccgcuaaaacucgccaauggcacaaaguaucggccucccgcaaaacugcuuaaggaacgcggauuuuucggcgcuauugccggguuucuggagggagguugggaaggcaugaucgcgggguggcauggauacaccagccacggcgcccacgguguugcaguggcugccgauuugaagaguacucaggaggcuauaaacaaaauuacgaagaaucucaacucucuguccgaauuagaggucaaaaaucugcagcgacucagcggggccauggacgagcuucauaacgaaauccuggaguuggaugaaaagguggacgaccuaagagcagauacaaucucgucucaaauugagcuggccguacuccuguccaaugaaggcaucauuaacucagaggacgagcaccuucuggcuuuggaaaggaaacucaagaagaugcugggaccaagugcgguugagauaggcaauggguguuucgaaaccaaacauaagugcaaccagacuugcuuagaucggaucgcagccggaaccuuugacgcuggugaguucagccugccuacauuugauucccuaaauauuaccgccgcaucucucaacgacgauggccuggacaaucacacuauccuuuuguauuacagcacagccgcuucaagucuggccgugacgcucaugaucgcaauuuucgucguguauauggucucccgugauaacgugagcuguucuauaugccuguga

SEQ ID NO: 149522 - RNA, 1758 nt, Artificial Sequence
  derived and/or modified sequence opt3 from hemagglutinin__InfluenzaB__AGX21568
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaugaugcaugaucguaccaaaaucagacaacugccuaaucuucugagggguuacgaacacauacgguugucgacacauaacguaaucaaugccgagaacgcaccagggggacccuauaagauuggcacuucaggcagcugcccuaauguuaccaacgggaauggauucuuugccacaauggcuugggcagugccgaaaaacgacaagaauaaaaccgccacgaacccacucacuaucgaaguccccuacauuuguacagagggugaggaucagaucaccguguggggcuuccacagugacaaugaaacucagauggcuaagcuguauggggauuccaagccucagaaauuuacaucuagcgccaacggagugaccacgcacuacgucucccaaauaggcgguuucccaaaccagaccgaggacgggggacugccccagucaggccgcauuguuguggauuauaugguacagaagaguggcaaaacagggacuaucaccuaccaaagagguauucucuuaccucagaagguguggugcgcgagcggaaggucuaaagucaucaagggcucccugccacuuaucggggaagcagacuguuugcaugagaaauauggaggccugaauaagucaaagcccuacuacacaggugagcacgccaaagcuauugggaacugcccgauaugggugaagacuccucuaaaacucgccaauggcaccaaguaucggcccccagcaaaacugcuuaaggaacgcggauuuuucggcgcuaucgccggguuucuggagggagguugggaaggcaugauugcgggguggcauggauacacaagccacggcgcccacgguguugcaguggcugccgauuugaagaguacccaggaggcuaucaacaaaauaacuaagaaucucaacucucuguccgaauuagaggucaaaaaucugcagcgacucagcggggccauggacgagcuucauaacgaaauucuggaguuggaugaaaagguggacgaccuaagagcagauacgaucucgucucaaaucgagcuggccguacuccuguccaaugaaggcauuaucaacucagaggacgagcaccuucuggcuuuggaaaggaaacucaagaagaugcugggaccuagugcgguugagauuggcaauggguguuucgaaacaaaacauaagugcaaccagaccugcuuagaucggauagcagccggaacuuuugacgcuggugaguucagccugcccaccuuugauucccuaaauaucacagccgcaucucucaacgacgauggccuggacaaucacaccauucuuuuguauuacagcacugccgcuucaagucuggccgugacacucaugaucgcaaucuucgucguguauauggucucccgugauaacgugagcuguucuauuugccuguga

SEQ ID NO: 149523 - RNA, 1758 nt, Artificial Sequence; identical to SEQ ID NO: 148624
  derived and/or modified sequence opt3 from hemagglutinin__InfluenzaB__AGX21579

SEQ ID NO: 149524 - RNA, 1758 nt, Artificial Sequence; identical to SEQ ID NO: 148661
  derived and/or modified sequence opt3 from hemagglutinin__InfluenzaB__AGX21590

SEQ ID NO: 149525 - RNA, 1758 nt, Artificial Sequence; identical to SEQ ID NO: 149474
  derived and/or modified sequence opt3 from hemagglutinin__InfluenzaB__AGX21601

SEQ ID NO: 149526 - RNA, 1758 nt, Artificial Sequence; identical to SEQ ID NO: 148661
  derived and/or modified sequence opt3 from hemagglutinin__InfluenzaB__AGX21611

SEQ ID NO: 149527 - RNA, 1758 nt, Artificial Sequence; identical to SEQ ID NO: 149005
  derived and/or modified sequence opt3 from hemagglutinin__InfluenzaB__AGX21622

SEQ ID NO: 149528 - RNA, 1758 nt, Artificial Sequence
  derived and/or modified sequence opt3 from hemagglutinin__InfluenzaB__AGX21633
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugguucagaagaguggcaaaacagggacuaucaccuaccaaagagguauucucuuaccucagaagguguggugcgcgagcggaaggucuaaaguaauaaagggcucccugccacuuaucggggaagcagacuguuugcaugagaaauauggaggccugaauaagucaaagcccuacuacacaggugagcacgccaaagcuauugggaacugcccgaucugggugaagacuccucuaaaacucgccaauggcaccaaguaucggcccccagcacgccugcuuaaagaacgaggauuuuucggcgcuauagccggguuucuggagggagguugggaaggcaugauugcgggguggcauggauacacaagccacggcgcccacggugucgcaguggcugccgauuugaagaguacccaggaggcuaucaacaagaucacuaaaaaucucaacucucuguccgaauuagagguuaagaaucugcagagacucagcggggccauggacgagcuucauaacgaaauucuggaguuggaugaaaaaguggacgaccuaagggcagauacgaucucgucucaaauugagcuggccguccuccuguccaaugaaggcauaaucaacucagaggacgagcaccuucuggcuuuggaacggaagcucaaaaagaugcugggaccuagugcgguggagauuggcaauggguguuucgaaacaaagcauaaaugcaaccagaccugcuuagaucguaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgcgauaacgugagcuguucuauuugccuguga

SEQ ID NO: 149529 - RNA, 1758 nt, Artificial Sequence; identical to SEQ ID NO: 148699
  derived and/or modified sequence opt3 from hemagglutinin__InfluenzaB__AGX21644

SEQ ID NO: 149530 - RNA, 1758 nt, Artificial Sequence; identical to SEQ ID NO: 148624
  derived and/or modified sequence opt3 from hemagglutinin__InfluenzaB__AGX21655

SEQ ID NO: 149531 - RNA, 1758 nt, Artificial Sequence
  derived and/or modified sequence opt3 from hemagglutinin__InfluenzaB__AGX21666
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggauaaaaucgcagccggaacuuuugacgcuggugaguucagcuuaccaaccuuugauucccugaauauuacagccgcaucucuaaacgacgauggccucgacaaucacaccauccugcuuuauuacagcacugccgcuucaaguuuggccgugacacugaugaucgcaauuuucgucguguauauggucucccgggauaacgugagcuguucuauaugccucuga

SEQ ID NO: 149532 - RNA, 1758 nt, Artificial Sequence; identical to SEQ ID NO: 148699
  derived and/or modified sequence opt3 from hemagglutinin__InfluenzaB__AGX21677

SEQ ID NO: 149533 - RNA, 1758 nt, Artificial Sequence; identical to SEQ ID NO: 148624
  derived and/or modified sequence opt3 from hemagglutinin__InfluenzaB__AGX21688

SEQ ID NO: 149534 - RNA, 1758 nt, Artificial Sequence
  derived and/or modified sequence opt3 from hemagglutinin__InfluenzaB__AGX21699
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaucucgccaacggcaccaaauaucggcccccagcaaagcugcuuaaagaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaauaagauuacuaaaaaccucaauucucuguccgaauuagaggucaagaaccugcagcgacucagcggggccauggacgagcuucauaaugaaauccuggaguuggaugaaaaaguggacgaccuaagagcagauacgaucucgucucaaauugagcuggccguacuccuguccaacgaaggcaucauuaauucagaggacgagcaccuucuggcuuuggaaaggaagcucaaaaagaugcugggaccuagugcgguugagauaggcaacggguguuucgaaacaaagcauaaaugcaaucagaccugcuuagaucggaucgcagccggaacuuuugacgcuggugaguucagccugcccaccuuugauucccuaaacauuacagccgcaucucucagcgacgauggccuggacaaucacaccauccuuuuguauuacucaacugccgcuaguucccuggccgugacacucaugaucgcaauuuucgucguguauauggucagccgugauaacgugucuuguucaauaugccuguga

SEQ ID NO: 149535 - RNA, 1758 nt, Artificial Sequence; identical to SEQ ID NO: 149474
  derived and/or modified sequence opt3 from hemagglutinin__InfluenzaB__AGX21710

SEQ ID NO: 149536 - RNA, 1758 nt, Artificial Sequence; identical to SEQ ID NO: 148699
  derived and/or modified sequence opt3 from hemagglutinin__InfluenzaB__AGX21721

SEQ ID NO: 149537 - RNA, 1755 nt, Artificial Sequence
  derived and/or modified sequence opt3 from hemagglutinin__InfluenzaB__AGX21732
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggggacccaugugcguuggcaucacuccuagcgccaaggcauccauucuccacgaagugcggccagucaccucugguuguuuucccaucaugcaugaucgcacaaagauacgacaacugccuaaucuucugcguggguacgagaaaaucagauugucggcccagaacgugauuaaugcugaaaaggcaccaggaggccccuauaaacucggcacuucagggagcugcccuaacgccaccaguaaguccggauucuuugcuacaauggccugggcgguaccaagggacgauaauaaaaccgcaacgaacccgcugacuguugaggugccccacaucugugccaaugaagaggaccagauuacagucugggguuuccauucugauaacaagacccagaugaagaaucuguacggcgacagcaacccucaaaaauuuacuuccucagcuaaugggaucacaacccacuaugugagucagauaggaggcuucccagaucagacggaggacggugggcucccccagagcggacggauuguggucgauuacaugguucaaaagccuggcaaaaccggcacaaucguguaucagcgcgggauuuuacugccacagaagguauggugcgccucuggaagauccaaagugaucaaggguucacuucccuugaucggcgaagcagacugucugcacgagaaauacgggggacuaaacaagagcaagccguauuacacuggcgaacaugcuaaagccauugguaacugcccuauaugggucaagacuccccucaaacuggcgaaugggacaaaguacaggccuccagccaaacuucugaaggagcggggcuuuuucggagcaaucgcuggcuuuuuggaagggggaugggaagguaugauugccggcuggcacggguauaccagucauggagcucacggcguggccguugcagccgaucucaagucuacccaggaggcuaucaacaaaauaacaaagaaucugaacuccuuaagcgaacuggaggugaaaaaucuccaacgccuuucgggugcgauggacgaacugcacaacgagauuuuggagcuagacgaaaaggucgaugaccugcgagcagauaccaucucuucccagaucgagcucgccgugcugcuuucaaaugaagggauuaucaacagugaggacgaacaucuguuggcucucgagagaaaacugaagaagauguuaggccccagcgccguagauauuggaaauggcuguuucgagacuaaacacaagugcaaccagacgugccuggacaggauagcagccgggacauuuaaugcuggagaguucucccuaccaaccuuugauucucucaacaucacugccgcaagccugaaugacgauggucuugacaaccauaccauuuugcuguacuauucaacagcggcuaguucccucgccguuacccugaugaucgcaaucuucauuguguacaugauaagccgggauaaugucucuuguucaaucugccuuuga

SEQ ID NO: 149538 - RNA, 1755 nt, Artificial Sequence
  derived and/or modified sequence opt3 from hemagglutinin__InfluenzaB__AGX21743
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaggacacggggcaaguuguguccggauugcuuaaacuguaccgaccuggauguugcgcuagggcgccccaugugcgugggaacgacuccuagcgcuaaagccuccauccuccacgaaguccgaccagugaccucuggcuguuuucccauuaugcaugaccguacaaagaucagacaacugccuaaucuucugagggguuacgagaacauacgguugucgacucagaauguaaucgaugcagaaaaggcccucgggggaccauaucgccugggcaccucaggcagcugccccaacgcuacaaguaaauccggguucuuugcaaccauggccugggcuguuccuaaggacaauaacaaaaaugccacgaacccacugacuguggaggucccguacauuuguacagaaggagaggaucagaucaccgugugggguuuccacucugacaauaagacucagaugaaaaaccucuauggcgauagcaauccccaaaaguuuacauccucagcgaacggggugaccacgcauuacgucagucagauuggaggcuucccugaccagaccgaggaugguggguuaccacagagcggaagaaucguuguggacuauaugguacaaaagcccggcaaaacaggcacuauaguguaccagaggggaguccugcuuccucagaagguguggugcgcaucugggaaauccaagguuauuaaagguucauugccacugaucggcgaagccgauugucuacacgagaaguaugggggacucaacaaaagcaagcccuacuacaccggcgaacacgcuaaggccauugguaauugcccgaucugggugaaaacaccucugaaacuugcaaacgggacuaaauaucggcccccagcuaagcuguugaaagagcgcggcuuuuucggagccaucgcgggcuuucucgaagggggaugggaagguaugauugccggcuggcauggguacaccagucacggagcacauggcgucgcuguggccgcugaccugaagucuacacaggaggccauaaauaagaucaccaaaaacuuaaauucccugagcgaacucgagguaaagaaccuucaacgacugucgggugcaauggacgaauugcacaaugagauucuagagcuggaugaaaaaguugacgaucucagagccgacacuaucucuucccagauagagcuggcugugcuucugucaaacgaagggauuaucaauagugaggaugaacacuugcucgcgcuggagaggaaguuaaagaagaugcugggcccuagcgcagucgacaucggaaacggcuguuucgagacgaagcauaaaugcaaucagacaugccuagaucggauugccgcugggaccuuuaacgccggagaguucucccuccccacuuuugacucucugaauaucaccgcagccagccuuaacgaugacgguuuggauaaucacacaauucugcucuauuacucaaccgcugccaguucccuggcagugacucuuaugcuggcgauauucaucgucuauauggugagccgugacaacguuucuuguucaauuugcuuguga

SEQ ID NO: 149539 - RNA, 1755 nt, Artificial Sequence
  derived and/or modified sequence opt3 from hemagglutinin__InfluenzaB__AGX21754
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccagcgaagagucauuucgcuaaucugaaagguaccaagacuaggggcaaauuguguccgacaugcuuaaacuguaccgaucuggacguggcccuagggggacccaugugcguuggcaucacgccuagcgcaaaggccuccauucuccacgaagugcggccagucacuucugguuguuuucccaucaugcaugaucgcaccaagauacgacaacugccuaaucuucugcguggguacgagaaaaucagauugucggcucagaacgugauuaaugcagaaaaggccccaggaggccccuauaaacucggcacaucagggagcugcccuaacgcuaccaguaaguccggauucuuugccacuauggcgugggcaguaccaagggacgauaauaaaacagccaccaacccgcugacgguugaggugccccacaucugugcuaaugaagaggaccagauuacugucugggguuuccauucugauaacaagacacagaugaagaaucuguacggcgacagcaacccucaaaaauuuaccuccucagccaaugggaucacuacacacuaugugagucagauaggaggcuucccagaucagaccgaggacggugggcucccccagagcggacggauuguggucgauuacaugguucaaaagccuggcaaaacgggcaccaucguguaucagcgcgggauuuuacugccacagaagguauggugcgcaucuggaagauccaaagugaucaaggguucacuucccuugaucggcgaagcugacugucugcacgagaaauacgggggacuaaacaagagcaagccguauuacacaggcgaacaugccaaagcgauugguaacugcccuauaugggucaagacuccccucaaacuggccaaugggaccaaguacaggccuccagcaaaacuucugaaggagcggggcuuuuucggagcuaucgccggcuuuuuggaagggggaugggaagguaugauugcuggcuggcacggguauacaagucauggagcccacggcguggcaguugccgcugaucucaagucuacucaggaggcgaucaacaaaauaaccaagaaucugaacuccuuaagcgaacuggaggugaaaaaucuccaacgccuuucgggugcaauggacgaacugcacaacgagauuuuggagcuagacgaaaaggucgaugaccugcgagccgauacaaucucuucccagaucgagcucgcugugcugcuuucaaaugaagggauuaucaacagugaggacgaacaucuguuggcccucgagagaaaacugaagaagauguuaggccccagcgcaguagauauuggaaauggcuguuucgagaccaaacacaagugcaaccagacuugccuggacaggauagccgcugggacguuuaaugccggagaguucucccuaccaacauuugauucucucaacaucaccgcagcgagccugaaugacgauggucuugacaaccauacuauuuugcuguacuauucaaccgcugccaguucccucgcaguuacacugaugaucgccaucuucauuguguacaugauaagccgggauaaugucucuuguucaaucugccuuuga

SEQ ID NO: 149540 - RNA, 1755 nt, Artificial Sequence
  derived and/or modified sequence opt3 from hemagglutinin__InfluenzaB__AGX21776
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaaucacgccuagcgcuaaagccuccauucuccaugaaguccgaccagugacuucuggcuguuuucccaucaugcacgaccguaccaagauaagacaacugccuaaucuucugagggguuaugagaacauccgguugucgacacagaauguaauugaugcagaaaaggccccagggggacccuaccgccucggcacuucaggcagcugcccuaacgcuaccaguaaauccggguucuuugcaacaauggccugggcuguuccaaaggacaauaacaaaaaugccaccaacccgcugacgguggagguccccuauguguguacugaaggagaggaucagaucacagugugggguuuccauucugacaauaagacccagaugaaaaaccuguacggcgauagcaauccucaaaaguuuacuuccucagcgaacggggucacaacccacuauguuagucagauuggaggcuucccagaccagacggaggauggugggcucccccagagcggaagaaucgugguagacuacauggugcaaaagccuggcaaaaccggcacaauagucuaucagaggggaguguuacugccacagaagguuuggugcgcaucugggcgguccaaagugauuaaggguucacuucccuugaucggcgaagccgauugucugcaugagaaauacgggggacuaaacaagagcaaaccguacuauacuggcgaacacgcuaaggccauugguaauugcccuaucugggucaagaccccucucaaacuggcaaacgggacaaaguaccgcccacccgcuaaacuucugaaggagcgaggcuuuuucggagccaucgcgggcuuuuuggaagggggaugggaagguaugauugccggcuggcacggguauacuucccauggagcacacggcguggcuguagccgcugaccucaaaucuacccaggaggccauaaauaagaucacaaagaaccugaauaguuuaagcgaacuggagguuaaaaaccuccaaagacuuucgggugcaauggacgaacugcauaaugagauuuuggagcuagaugaaaagguggacgaucugagggccgacaccaucucuucccagauagagcucgcuguccugcuuucaaacgaagggauuaucaauagugaggaugaacaccuguuggcgcucgagcggaaacugaagaaaauguuaggccccagcgcaguggacaucggaaacggcuguuucgagacuaagcacaagugcaaucagacgugccuggaucguauugccgcugggacauuuaacgccggagaguucucccuaccaaccuuugacucucucaauaucacugcagccagccugaacgaugacggucuugauaaucauaccauuuugcuguacuauucaacagcugccaguucccucgcagucacccugaugcuugcgauauucaucguguacaugguuagccgcgacaacgugucuuguucaauuugccuguga

SEQ ID NO: 149541 - RNA, 1758 nt, Artificial Sequence; identical to SEQ ID NO: 148995
  derived and/or modified sequence opt3 from hemagglutinin__InfluenzaB__AGX21787

SEQ ID NO: 149542 - RNA, 1755 nt, Artificial Sequence
  derived and/or modified sequence opt3 from hemagglutinin__InfluenzaB__AGX21798
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauguguguacagaaggagaggaucagauuaccgugugggguuuccauucugacaauaagacucagaugaaaaaccuguacggcgauagcaauccucaaaaguuuacauccucagcgaacggggucaccacgcacuauguuagucagaucggaggcuucccagaccagaccgaggauggugggcucccccagagcggaagaauugugguagacuacauggugcaaaagccuggcaaaacaggcacuaucgucuaucagaggggaguguuacugccacagaagguuuggugcgcaucugggcgguccaaagugauaaaggguucacuucccuugauuggcgaagccgauugucugcaugagaaauacgggggacuaaacaagagcaaaccguacuauaccggcgaacacgcuaaggccaucgguaauugcccuauuugggucaagacaccccucaaacuggcaaacgggacuaaguaccgcccuccagcuaaacuucugaaggagcgaggcuuuuucggagccaucgcgggcuuuuuggaagggggaugggaagguaugaucgccggcuggcacggguauaccagucauggagcacacggcguggcuguagccgcugaccucaaaucuacacaggaggccauuaauaagauaaccaagaacuuaaauucccugagcgaacuggagguuaaaaaccuccaaagacuuucgggugcaauggacgaacugcauaaugagaucuuggagcuagaugaaaagguggacgaucugagggccgacacuauuucuucccagaucgagcucgcuguccugcuuucaaacgaagggauaauuaauagugaggaugaacaccuguuggcgcucgagcggaaacugaagaaaauguuaggccccagcgcaguggacaucggaaacggcuguuucgagacgaagcacaagugcaaucagacaugccuggaucguaucgccgcugggaccuuuaacgccggagaguucucccuaccaacuuuugacucucucaauauuaccgcagccagccugaacgaugacggucuugauaaucauacaaucuugcuguacuauucaaccgcugccaguucccucgcagucacucugaugcuugcgauuuucauaguguacaugguuagccgcgacaacgugucuuguucaaucugccuguga

SEQ ID NO: 149543 - RNA, 1755 nt, Artificial Sequence
  derived and/or modified sequence opt3 from hemagglutinin__InfluenzaB__AGX21809
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauguguguacagaaggagaggaucagauuaccgugugggguuuccauucugacaauaagacucagaugaaaaaccuguacggcgauagcaauccucaaaaguuuacauccucagcgaacggggucaccacgcacuauguuagucagaucggaggcuucccagaccagaccgaggauggugggcucccccagagcggaagaauugugguagacuacauggugcaaaagccuggcaaaacaggcacuaucgucuaucagaggggaguguuacugccacagaagguuuggugcgcaucugggcgguccaaagugauaaaggguucacuucccuugauuggcgaagccgauugucugcaugagaaauacgggggacuaaacaagagccgcccguacuauaccggcgaacacgcuaaagccaucgguaauugcccuauuugggucaagacaccccucaagcuggcaaacgggacuaaauaccgaccuccagcuaagcugcugaaagagagaggcuuuuucggagccaucgcgggcuuuuuggaagggggaugggaagguaugaucgccggcuggcacggguauaccagucauggagcacacggcguggcuguagccgcugaccucaagucuacacaggaggccauuaauaaaauaaccaagaaccuuaauuccuuaagcgaacuggagguuaagaaccuccaaaggcuuucgggugcaauggacgaacugcauaaugagaucuuggagcuagaugaaaaaguggacgaucugcgggccgacacuauuucuucccagaucgagcucgcuguccugcuuucaaacgaagggauaauuaauagugaggaugaacaccuguuggcgcucgagcguaagcugaaaaagauguuaggccccagcgcaguggacaucggaaacggcuguuucgagacgaaacacaagugcaaucagacaugccuggaucgcaucgccgcugggaccuuuaacgccggagaguucucccuaccaacuuuugacucucucaauauuaccgcagccagccugaacgaugacggucuugauaaucauacaaucuugcuguacuauucaaccgcugccaguucccucgcagucacucugaugcuugcgauuuucauaguguacaugguuagcagagacaacgugucuuguucaaucugccuguga

SEQ ID NO: 149544 - RNA, 1755 nt, Artificial Sequence
  derived and/or modified sequence opt3 from hemagglutinin__InfluenzaB__AGX21820
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaauaaaaguggguucuuugcaaccauggccugggcuguuccaaaggacaacaauaaaaacgccacgaauccgcugacuguggagguccccuauauuuguacagaaggagaggaucagaucaccgugugggguuuccauuccgacaacaagacucagaugaaaaaucuguacggcgauucuaacccucaaaaguuuacaagcuccgcgaacggggugaccacgcacuaugucucacagauuggaggcuucccagaccagaccgaggauggugggcucccccagaguggaagaaucguuguggacuacaugaugcaaaagccuggcaaaacaggcacuauaguauaucagaggggaguguuacugccacagaaggucuggugcgcaagcgggcggucuaaagugauuaaggguucccuucccuugaucggcgaagccgauugucugcaugagaaauacgggggacuaaauaagucaaaaccguacuauaccggcgaacacgcuaaggccauugguaacugcccuaucuggguuaagacaccccucaaacuggcaaaugggacuaaguaccgcccuccagcuaaacuucugaaggagcgaggcuuuuucggagccaucgcgggcuuuuuggaagggggaugggaagguaugauugccggcuggcacggguauaccagccauggagcacacggcguggcugucgccgcugaccucaaaaguacacaggaggccauaaacaagaucaccaagaaucugaacucuuuauccgaacuggaggugaaaaaucuccaaagacuuagcggugcaauggacgaacugcauaacgagauuuuggagcuagaugaaaagguagacgaucugagggccgacacuaucucgucucagauagagcucgcuguucugcuuuccaaugaagggauuaucaacucagaggaugaacaccuguuggcgcucgagcggaaacugaagaaaauguuaggccccagugcaguggacaucggaaauggcuguuucgagacgaagcacaagugcaaccagacaugccuggaucguauugccgcugggaccuuuaaugccggagaguucagccuaccaacuuuugacucccucaacaucaccgcagccucucugaaugaugacggucuugauaaccauacaauuuugcuguacuauagcaccgcugccucaagucucgcagucacucugaugcuugcgauauucaucguguacauggucucccgcgacaacgugagcuguucuauuugccuguga

SEQ ID NO: 149545 - RNA, 1755 nt, Artificial Sequence; identical to SEQ ID NO: 149039
  derived and/or modified sequence opt3 from hemagglutinin__InfluenzaB__AGX21831

SEQ ID NO: 149546 - RNA, 1755 nt, Artificial Sequence; identical to SEQ ID NO: 149042
  derived and/or modified sequence opt3 from hemagglutinin__InfluenzaB__AGX21842

SEQ ID NO: 149547 - RNA, 1755 nt, Artificial Sequence; identical to SEQ ID NO: 149042
  derived and/or modified sequence opt3 from hemagglutinin__InfluenzaB__AGX21853

SEQ ID NO: 149548 - RNA, 1755 nt, Artificial Sequence
  derived and/or modified sequence opt3 from hemagglutinin__InfluenzaB__AGX21864
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgaaucagaacguaaucgaugcagaaaaggccccagggggacccuaccgccucggcacuucaggcagcugcccuaaugcuaccaguaaauccggguucuuugcaacaauggccugggcuguuccaaaggacaacaauaaaaacgccaccaauccgcugacgguggagguccccuauauuuguacugaaggagaggaucagaucacagugugggguuuccauucugacaacaagacccagaugaaaaaucuguacggcgauagcaacccucaaaaguuuacuuccucagcgaacggggugacaacccacuaugucagucagauuggaggcuucccagaccagacggaggauggugggcucccccagagcggaagaaucguuguggacuacaugaugcaaaagccuggcaaaaccggcacaauaguauaucagaggggaguguuacugccacagaaggucuggugcgcaucugggcgguccaaagugauuaaggguucacuucccuugaucggcgaagccgauugucugcaugagaaauacgggggacuaaauaagagcaaaccguacuauacuggcgaacacgcuaaggccauugguaacugcccuaucuggguuaagacuccccucaaacuggcaaaugggacaaaguaccgcccuccagcuaaacuucugaaggagcgaggcuuuuucggagccaucgcgggcuuuuuggaagggggaugggaagguaugauugccggcuggcacggguauaccagucauggagcacacggcguggcugucgccgcugaccucaaaucuacccaggaggccauaaacaagaucacaaagaaucugaacuccuuaagcgaacuggaggugaaaaaucuccaaagacuuucgggugcaauggacgaacugcauaacgagauuuuggagcuagaugaaaagguagacgaucugagggccgacaccaucucuucccagauagagcucgcuguucugcuuucaaaugaagggauuaucaacagugaggaugaacaccuguuggcgcucgagcggaaacugaagaaaauguuaggccccagcgcaguggacaucggaaauggcuguuucgagacuaagcacaagugcaaccagacgugccuggaucguauugccgcugggacauuuaaugccggagaguucucccuaccaaccuuugacucucucaacaucacugcagccagccugaaugaugacggucuugauaaccauaccauuuugcuguacuauucaacagcugccaguucccucgcagucacccugaugcuugcgauauucaucguguacauggucagccgcgacaacgugucuuguucaauuugccuguga

SEQ ID NO: 149549 - RNA, 1755 nt, Artificial Sequence; identical to SEQ ID NO: 149040
  derived and/or modified sequence opt3 from hemagglutinin__InfluenzaB__AGX21875

SEQ ID NO: 149550 - RNA, 1755 nt, Artificial Sequence; identical to SEQ ID NO: 149039
  derived and/or modified sequence opt3 from hemagglutinin__InfluenzaB__AGX21886

SEQ ID NO: 149551 - RNA, 1755 nt, Artificial Sequence; identical to SEQ ID NO: 149039
  derived and/or modified sequence opt3 from hemagglutinin__InfluenzaB__AGX21897

SEQ ID NO: 149552 - RNA, 1755 nt, Artificial Sequence; identical to SEQ ID NO: 149039
  derived and/or modified sequence opt3 from hemagglutinin__InfluenzaB__AGX21908

SEQ ID NO: 149553 - RNA, 1755 nt, Artificial Sequence
  derived and/or modified sequence opt3 from hemagglutinin__InfluenzaB__AGX21919
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaagcaggcacaauaguauaucagaggggaguguuacugccacagaaggucuggugcgccucugggcgguccaaagugauuaaggguucacuucccuugaucggcgaagcugauugucugcaugagaaauacgggggacuaaacaagagcaaaccguacuauacuggcgaacacgccaaggcaauugguaauugcccuaucuggguuaagaccccucucaaacuggcuaacgggacaaaguaccgcccacccgccaaacuucugaaggagcgaggcuuuuucggagcgaucgccggcuuuuuggaagggggaugggaagguaugauugcaggcuggcacggguauacuucccauggagcucacggcguggccgucgcugccgaccucaaaucuacccaggaggcaauaaauaagaucacaaagaaccugaauaguuuaagcgaacuggaggugaaaaaccuccaaagacuuucgggugccauggacgaacugcauaaugagauuuuggagcuagaugaaaagguagacgaucugagggcugacaccaucucuucccagauagagcucgcgguucugcuuucaaacgaagggauuaucaauagugaggaugaacaccuguuggcacucgagcggaaacugaagaaaauguuaggccccagcgccguggacaucggaaacggcuguuucgagacuaagcacaagugcaaucagacgugccuggaucguauugcugccgggacauuuaacgcaggagaguucucccuaccaaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgcgacaacgugucuuguucaauuugccuguga

SEQ ID NO: 149554 - RNA, 1755 nt, Artificial Sequence; identical to SEQ ID NO: 149042
  derived and/or modified sequence opt3 from hemagglutinin__InfluenzaB__AGX21941

SEQ ID NO: 149555 - RNA, 1755 nt, Artificial Sequence; identical to SEQ ID NO: 149039
  derived and/or modified sequence opt3 from hemagglutinin__InfluenzaB__AGX21952

SEQ ID NO: 149556 - RNA, 1755 nt, Artificial Sequence; identical to SEQ ID NO: 149042
  derived and/or modified sequence opt3 from hemagglutinin__InfluenzaB__AGX21963

SEQ ID NO: 149557 - RNA, 1755 nt, Artificial Sequence
  derived and/or modified sequence opt3 from hemagglutinin__InfluenzaB__AGX21974
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggugaauaacaaaaaugccacgaacccgcugacugucgaggugcccuauauuuguacagaaggagaggaccagaucaccgugugggguuuccauucugauaauaagacucagaugaaaaaccuguacggcgacagcaauccucaaaaguuuacauccucagcgaacggggucaccacgcacuauguuagucagauuggcagcuucccagaucagaccgaggacggaggucucccccagucugggagaaucgugguagauuacaugaugcaaaagccuggaaaaacaggcacuauaguguaucagaggggcgucuuacugccacagaagguguggugcgcauccgggcggucaaaaguuauuaagggaagccuucccuugaucggugaagccgacugucugcaugagaaauacggcgggcuaaacaagaguaaaccguacuauaccggagaacacgcuaaggccauuggcaauugcccuaucugggugaagacaccccucaaacuggcaaacgguacuaaguaccgcccuccagcuaaacuucugaaggagcgaggguuuuucggcgccaucgcgggauuuuuggagggcgggugggaaggaaugauugccgguuggcacggcuauaccucucauggggcacacggagucgcuguggccgcugaucucaaauccacacaggaggccauaaauaagaucaccaagaaccugaauagcuuaucggaacuggagguuaaaaaccuccaaagacuuucuggcgcaauggacgaacugcauaaugagauuuuggagcuagacgaaaagguagaugaccugagggccgauacuaucuccucacagauagagcucgcugugcugcuuaguaacgaagguauuaucaauagcgaggacgaacaccuguuggcgcucgagcggaaacugaagaaaauguuagggcccuccgcagucgauaucggcaacggauguuucgagacgaagcacaagugcaaucagacaugccuggaccguauugccgcuggcaccuuuaacgccggggaguucucucuaccaacuuuugauagccucaauaucaccgcagccucacugaacgacgauggacuugacaaucauacaauuuugcuguacuauaguaccgcugccuccagccucgcagugacucugaugcuugcgauauucaucgucuacaugauuucucgcgauaacgugucauguaguaucugccuguga

SEQ ID NO: 149558 - RNA, 1755 nt, Artificial Sequence; identical to SEQ ID NO: 149042
  derived and/or modified sequence opt3 from hemagglutinin__InfluenzaB__AGX21985

SEQ ID NO: 149559 - RNA, 1755 nt, Artificial Sequence; identical to SEQ ID NO: 149040
  derived and/or modified sequence opt3 from hemagglutinin__InfluenzaB__AGX21996

SEQ ID NO: 149560 - RNA, 1755 nt, Artificial Sequence; identical to SEQ ID NO: 149040
  derived and/or modified sequence opt3 from hemagglutinin__InfluenzaB__AGX22007

SEQ ID NO: 149561 - RNA, 1755 nt, Artificial Sequence; identical to SEQ ID NO: 149039
  derived and/or modified sequence opt3 from hemagglutinin__InfluenzaB__AGX22018

SEQ ID NO: 149562 - RNA, 1755 nt, Artificial Sequence; identical to SEQ ID NO: 149039
  derived and/or modified sequence opt3 from hemagglutinin__InfluenzaB__AGX22029

SEQ ID NO: 149563 - RNA, 1755 nt, Artificial Sequence; identical to SEQ ID NO: 149039
  derived and/or modified sequence opt3 from hemagglutinin__InfluenzaB__AGX22040

SEQ ID NO: 149564 - RNA, 1755 nt, Artificial Sequence
  derived and/or modified sequence opt3 from hemagglutinin__InfluenzaB__AGX22051
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaucgaggauggugggcucccccagagcggaagaauaguuguggacuacaugaugcaaaagccuggcaaaaccggcacaauuguauaucagaggggaguguuacugccacagaaggucuggugcgcaucugggcgguccaaagugaucaaggguucacuucccuugauuggcgaagccgauugucugcaugagaaauacgggggacuaaacaagagcaaaccguacuauacuggcgaacacgcuaaggccaucgguaauugcccuaucuggguuaagaccccucucaaacuggcaaacgggacaaaguaccgcccacccgcuaaacuucugaaggagcgaggcuuuuucggagccauugcgggcuuuuuggaagggggaugggaagguaugauagccggcuggcacggguauacuucccauggagcacacggcguggcugucgccgcugaccucaaaucuacccaggaggccaucaauaagauuacaaagaaccugaauaguuuaagcgaacuggaggugaaaaaccuccaaagacuuucgggugcaauggacgcccugcauaaugaaaucuuggagcuagaugagaagguagacgaucugagggcugacaccauaucuucccagauugaacucgcgguucugcuuucaaacgaggggaucaucaauagugaagaugagcaccuguuggcacucgaacggaaacugaagaaaauguuaggccccagcgccguggagauuggaaacggcuguuucgagacuaagcacaagugcaaucagacgugccuggaccguaucgcugccgggacauuuaacgcaggagaguucucccuaccaaccuuugauucucucaauauuacugccgcuagccugaacgacgauggucuugacaaucauaccauauugcuguacuauucaacagccgcaaguucccucgcggucacccugaugcuugcuaucuucauuguguacauggucagccgcgauaacgugucuuguucaaucugccuguga

SEQ ID NO: 149565 - RNA, 1755 nt, Artificial Sequence; identical to SEQ ID NO: 149039
  derived and/or modified sequence opt3 from hemagglutinin__InfluenzaB__AGX22062

SEQ ID NO: 149566 - RNA, 1755 nt, Artificial Sequence
  derived and/or modified sequence opt3 from hemagglutinin__InfluenzaB__AGX22073
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuauugaagggggaugggaggguaugauagccggcuggcacggguauaccagucauggagcacacggcguggcugucgccgcugacuugaaaucuacacaggaggccaucaauaagauuaccaagaaccucaauucccugagcgaauuagaggugaaaaaccugcaaagacucucgggugcaauggacgaacuucauaaugagauccuggaguuggaugaaaagguagacgaucuaagggccgacacuauaucuucccagauugagcuggcuguucuccugucaaacgaagggaucaucaauagugaggaugaacaccuucuggcguuggagcggaaacucaagaaaaugcugggccccagcgcaguggacauuggaaacggcuguuucgagacgaagcacaagugcaaucagacaugcuuagaucguaucgccgcugggaccuuuaacgccggagacuucucccugccaacuuuugauucucuaaauauuaccgcagccagccucaacgacgauggucuggacaaucauacaauacuuuuguacuauucaaccgcugccaguucccuggcagucacucucaugcuggcgaucuucauuguguacauggucagccgcgacaacgugucuuguucaaucugccuuuga

SEQ ID NO: 149567 - RNA, 1755 nt, Artificial Sequence; identical to SEQ ID NO: 149042
  derived and/or modified sequence opt3 from hemagglutinin__InfluenzaB__AGX22095

SEQ ID NO: 149568 - RNA, 1755 nt, Artificial Sequence; identical to SEQ ID NO: 149040
  derived and/or modified sequence opt3 from hemagglutinin__InfluenzaB__AGX22106

SEQ ID NO: 149569 - RNA, 1755 nt, Artificial Sequence
  derived and/or modified sequence opt3 from hemagglutinin__InfluenzaB__AGX22128
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacucagaugaagaaucuguacggcgauagcaacccucaaaaauuuacauccucagcgaacggggucaccacgcacuauguuagucagaucggaggcuucccagcacagaccgaggacggugggcucccccagagcggaagaauugugguagauuacauggugcaaaagccuaggaagacaggcacuaucgucuaucagcggggcguguuacugccacagaaaguuuggugcgccucugggcgcuccaaggugauaaaaggaucacuucccuugauuggugaagcugacugucugcaugagaaguacggcgggcuaaauaaaagcaagccguacuauaccggagaacacgccaaagcaaucggcaacugcccuauuugggucaagacaccccucaagcuggcuaaugguacuaaauaccgaccuccagccaaacuucugaaggagagaggguuuuucggcgcgaucgccggauuuuuggagggcgggugggaaggaaugaucgcagguuggcacggcuauaccagucauggggcucacggaguggccguagcugccgaucucaagucuacacaggaggcaauuaacaaaauaaccaagaaucugaacuccuuaagcgaacuggagaucaagaaucuccaaaggcuuucgggcgccaugaacgaacugcauaaugagauuuuggagcuagacgaaaaaguugacgaucugcgggcugacacuaucucuucccagauagagcucgcggugcugcuuucaaacgaagguauuaucaauagugaggaugaacaccuguuggcacucgagcguaagcugaaaaagauguuagggcccagcgccgucgacaucggcaacggauguuucgagacgaaacacaagugcaaucagacaugccuggaucgcauugcugccggcaccuuuaacgcaggggaguucucccuaccaacuuuugacucucucaauaucaccgccgcuagccugaacgaugacggacuugauaaccauacaauuuugcuguacuauucaaccgccgcaaguucccucgcggugacucugaugcuugcuauauucaucgucuacauggugagcagagacaauguuucuuguucaauuugccuguga

SEQ ID NO: 149570 - RNA, 1755 nt, Artificial Sequence
  derived and/or modified sequence opt3 from hemagglutinin__InfluenzaB__AGX22139
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcugaagccuccauccuccaugagguccgaccagugaccucuggcuguuuucccauuaugcacgaccguacaaaaaucagacaacugccuaaucuucugagggguuaugaaaacauacgguugucgacucagaauguaaucgaugcagagaaggccccagggggacccuaccgccucggcaccucaggcagcugcccuaacgcuacaaguaaguccggguucuuugcaaccauggccugggcuguuccaaaagacaauaacaagaaugccacgaacccgcugacuguggaaguccccuauauuuguacagagggagaggaucagaucaccgugugggguuuccauucugacaauaaaacucagaugaagaaccuguacggcgauagcaauccucaaaaauuuacauccucagcgaacggggugaccacgcacuaugucagucagauuggaggcuucccagaccagaccgaagauggugggcucccccagagcggaagaaucguuguggacuacaugaugcaaaagccuggcaagacaggcacuauaguauaucagaggggaguguuacugccacagaaagucuggugcgcaucugggcgguccaaggugauuaaagguucacuucccuugaucggcgaggccgauugucugcaugaaaaguacgggggacuaaacaaaagcaagccguacuauaccggcgagcacgcuaaagccauugguaauugcccuaucuggguuaagacaccccucaagcuggcaaacgggacuaaauaccgcccuccagcuaagcugcugaaagagcgaggcuuuuucggagccaucgcgggcuuuuuggaagggggaugggaggguaugauugccggcuggcacggguauaccagucauggagcacacggcguggcugucgccgcugaccucaagucuacacaggaagccauaaauaaaaucaccaagaaccuuaauuccuuaagcgagcuggaagugaagaaccuccaaagacuuucgggugcaauggacgagcugcauaaugagauuuuggaacuagaugagaaaguagacgaucugagggccgacacuaucucuucccagauagaacucgcuguucugcuuucaaacgaggggauuaucaauagugaagaugagcaccuguuggcgcucgagcggaagcugaaaaagauguuaggccccagcgcaguggacaucggaaacggcuguuucgaaacgaaacacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcagucacucugaugcuugcgauauucaucguguacauggucagccgcgacaacgugucuuguucaauuugccuguga

SEQ ID NO: 149571 - RNA, 1755 nt, Artificial Sequence; identical to SEQ ID NO: 149570
  derived and/or modified sequence opt3 from hemagglutinin__InfluenzaB__AGX22150

SEQ ID NO: 149572 - RNA, 1755 nt, Artificial Sequence; identical to SEQ ID NO: 149570
  derived and/or modified sequence opt3 from hemagglutinin__InfluenzaB__AGX22161

SEQ ID NO: 149573 - RNA, 1755 nt, Artificial Sequence; identical to SEQ ID NO: 149039
  derived and/or modified sequence opt3 from hemagglutinin__InfluenzaB__AGX22172

SEQ ID NO: 149574 - RNA, 1755 nt, Artificial Sequence; identical to SEQ ID NO: 149570
  derived and/or modified sequence opt3 from hemagglutinin__InfluenzaB__AGX22183

SEQ ID NO: 149575 - RNA, 1755 nt, Artificial Sequence; identical to SEQ ID NO: 149570
  derived and/or modified sequence opt3 from hemagglutinin__InfluenzaB__AGX22194

SEQ ID NO: 149576 - RNA, 1755 nt, Artificial Sequence; identical to SEQ ID NO: 149570
  derived and/or modified sequence opt3 from hemagglutinin__InfluenzaB__AGX22205

SEQ ID NO: 149577 - RNA, 1755 nt, Artificial Sequence; identical to SEQ ID NO: 149040
  derived and/or modified sequence opt3 from hemagglutinin__InfluenzaB__AGX22216

SEQ ID NO: 149578 - RNA, 1755 nt, Artificial Sequence; identical to SEQ ID NO: 149042
  derived and/or modified sequence opt3 from hemagglutinin__InfluenzaB__AGX22227

SEQ ID NO: 149579 - RNA, 1755 nt, Artificial Sequence
  derived and/or modified sequence opt3 from hemagglutinin__InfluenzaB__AGX22238
augaaggccaucauugugcugcucauggucguuaccagcaacgcugacagaauaugcacaggcaucacuuccucuaauucaccccacauggugaaaacggcaacccagggggagguaaacgugacaggagucauuccucuuacuaccacaccaaccaagaguuacuucgccaaucugaaagguacuaggacacggggcaaguuguguccggauugcuuaaacuguaccgaccuggauguggcgcuagggcgccccaugugcguuggaacgacuccuagcgcuaaagccuccauccuccaugaagugcgaccagucaccucuggcuguuuucccauuaugcacgaccguacaaagaucagacaacugccuaaucuucugagggguuaugagaacauacgguugucgacucagaaugugaucgaugcagaaaaggccccagggggacccuaccgccucggcaccucaggcagcugcccuaacgcuacaaguaaauccggguucuuugcaaccauggccugggcuguaccaaaggacaauaacaaaaaugccacgaacccgcugacuguugaggugcccuauauuuguacagaaggagaggaucagaucaccgucugggguuuccauucugacaauaagacucagaugaaaaaccuguacggcgauagcaauccucaaaaguuuacauccucagcgaacggggugaccacgcacuaugugagucagauuggaggcuucccagaccagaccgaggauggugggcucccccagagcggaagaaucgucguugacuacaugaugcaaaagccuggcaaaacaggcacuauaguguaucagaggggaguauuacugccacagaagguguggugcgcaucugggcgguccaaagucauuaaggguucacuucccuugaucggcgaagccgauugucugcaugagaaauacgggggacuaaacaagagcaaaccguacuauaccggcgaacacgcuaaggccauugguaauugcccuaucugggugaagacaccccucaaacuggcaaacgggacuaaguaccgcccuccagcuaaacuucugaaggagcgaggcuuuuucggagccaucgcgggcuuuuuggaagggggaugggaagguaugauugccggcuggcacggguauaccagucauggagcacacggcguugcuguggccgcugaccucaaaucuacacaggaggccauaaauaagaucaccaagaacuuaaauucccugagcgaacuggaggucaaaaaccuccaaagacuuucgggugcaauggacgaacugcauaaugagauuuuggagcuagaugaaaagguggacgaucugagggccgacacuaucucuucccagauagagcucgcuguacugcuuucaaacgaagggauuaucaauagugaggaugaacaccuguuggcgcucgagcggaaacugaagaaaauguuaggccccagcgcaguugacaucggaaacggcuguuucgagacgaagcacaagugcaaucagacaugccuggaucguauugccgcugggaccuuuaacgccggagaguucucccuaccaacuuuugacucucucaauaucaccgcagccagccugaacgaugacggucuugauaaucauacaauuuugcuguacuauucaaccgcugccaguucccucgcagugacucugaugcuugcgauauucaucgucuacauggugagccgcgacaacgucucuuguucaauuugccuguga

SEQ ID NO: 149580 - RNA, 1755 nt, Artificial Sequence; identical to SEQ ID NO: 149040
  derived and/or modified sequence opt3 from hemagglutinin__InfluenzaB__AGX22249

SEQ ID NO: 149581 - RNA, 1755 nt, Artificial Sequence; identical to SEQ ID NO: 149039
  derived and/or modified sequence opt3 from hemagglutinin__InfluenzaB__AGX22260

SEQ ID NO: 149582 - RNA, 1755 nt, Artificial Sequence
  derived and/or modified sequence opt3 from hemagglutinin__InfluenzaB__AGX22271
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccaagugcuaaacuucugaaggagcgaggcuuuuucggagccaucgcgggcuuuuuggaagggggaugggaggguaugauugccggcuggcacggguauaccucucauggagcacacggcguggcugucgccgcugaccucaaauccacacaggaggccauaaauaagaucaccaagaaccugaauagcuuaucggaacuggaggugaaaaaccuccaaagacuuucuggugcaauggacgaacugcauaaugagauuuuggagcuagaugaaaagguagacgaucugagggccgacacuaucuccucacagauagagcucgcuguucugcuuaguaacgaagggauuaucaauagcgaggaugaacaccuguuggcgcucgagcggaaacugaagaaaauguuaggcccuuccgcaguggagaucggaaacggcuguuucgaaacgaagcacaagugcaaucagacaugccuggaccguauugccgcugggaccuuuaacgccggagaguucucucuacccacuuuugauagccucaauaucaccgcagccucacugaacgacgauggucuugacaaucauacaauuuugcuguacuauaguaccgcugccuccagccucgcagucacucugaugcuugcgauauucaucguguacauggucucucgcgauaacgugucauguaguauuugccuguga

SEQ ID NO: 149583 - RNA, 1755 nt, Artificial Sequence
  derived and/or modified sequence opt3 from hemagglutinin__InfluenzaB__AGX22282
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggagacuucccagaucagaccgaggacggcggucucccccagagcgggagaaucguuguggauuacaugaugcaaaagccuggaaaaacaggcacuauaguauaucagaggggcguguuacugccacagaaggucuggugcgcaucugggcgguccaaagugauuaagggaucacuucccuugaucggugaagccgacugucugcaugagaaauacggcgggcuaaacaagagcaaaccguacuauaccggagaacacgcuaaggccauuggcaauugcccuaucuggguuaagacaccccucaaacuggcaaacgguacuaaguaccgcccuccagcuaaacuucugaaggagcgaggguuuuucggcgccaucgcgggauuuuuggagggcgggugggaaggaaugauugccgguuggcacggcuauaccagucauggggcacacggaguggcugucgccgcugaccucaaaucuacacaggaggccauaaauaagaucaccaagaacuuaaauucccugagcgaacuggaggugaaaaaccuccaaagacuuucgggcgcaauggaugaacugcauaaugagauuuuggagcuagacgaaaagguagaugaccugagggccgauacuaucucuucccagauagagcucgcuguucugcuuucaaacgaagguauuaucaauagugaggacgaacaccuguuggcgcucgagcggaaacugaagaaaauguuagggcccagcgcaguggauaucggcaacggauguuucgagacgaagcacaagugcaaucagacaugccuggaccguauugccgcuggcaccuuuaacgccggggaguucucccuaccaacuuuugauucucucaauaucaccgcagccagccugaacgacgauggacuugacaaucauacaauuuugcuguacuauucaaccgcugccaguucccucgcagucacucugaugcuugcgauauucaucguguacauggucagccgcgacaacgugucuuguucaauuugccuguga

SEQ ID NO: 149584 - RNA, 1755 nt, Artificial Sequence; identical to SEQ ID NO: 149039
  derived and/or modified sequence opt3 from hemagglutinin__InfluenzaB__AGX22293

SEQ ID NO: 149585 - RNA, 1755 nt, Artificial Sequence
  derived and/or modified sequence opt3 from hemagglutinin__InfluenzaB__AGX22304
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucaaccaacggggugacgacccacuaugucagucagauuggaggcuucccagaccagacagaggauggugggcucccccagagcggaagaaucguuguggacuacaugaugcaaaagccuggcaaaacuggcaccauaguauaucagaggggaguguuacugccacagaaggucuggugcgcgucugggcgguccaaagugauuaaggguucacuucccuugaucggcgaagcagauugucugcaugagaaauacgggggacuaaacaagagcaaaccguacuauacaggcgaacacgccaaggcuauugguaauugcccuaucuggguuaagacuccccucaaacuggccaacgggaccaaguaccgcccuccagcaaaacuucugaaggagcgaggcuuuuucggagcuaucgccggcuuuuuggaagggggaugggaagguaugauugcgggcuggcacggguauacaagucauggagcccacggcguggcagucgcugccgaccucaaaucuacccaggaggcuauaaauaagaucacuaagaacuuaaauucccugagcgaacuggaggugaaaaaccuccaaagacuuucgggugccauggacgaacugcauaaugagauuuuggagcuagaugaaaagguagacgaucugagggcagacacgaucucuucccagauagagcucgccguucugcuuucaaacgaagggauuaucaauagugaggaugaacaccuguuggcucucgagcggaaacugaagaaaauguuaggccccagcgcgguggacaucggaaacggcuguuucgagacaaagcacaagugcaaucagaccugccuggaucguauugcagccgggacuuuuaacgcuggagaguucucccuaccaaccuuugacucucucaauaucacagccgcaagccugaacgaugacggucuugauaaucauaccauuuugcuguacuauucaacugccgcuaguucccucgccgucacacugaugcuugcaauauucaucguguacauggucagccgcgacaacgugucuuguucaauuugccuguga

SEQ ID NO: 149586 - RNA, 1755 nt, Artificial Sequence; identical to SEQ ID NO: 149039
  derived and/or modified sequence opt3 from hemagglutinin__InfluenzaB__AGX22315

SEQ ID NO: 149587 - RNA, 1755 nt, Artificial Sequence; identical to SEQ ID NO: 148442
  derived and/or modified sequence opt3 from hemagglutinin__InfluenzaB__AGX22326

SEQ ID NO: 149588 - RNA, 1755 nt, Artificial Sequence; identical to SEQ ID NO: 149042
  derived and/or modified sequence opt3 from hemagglutinin__InfluenzaB__AGX22337

SEQ ID NO: 149589 - RNA, 1755 nt, Artificial Sequence; identical to SEQ ID NO: 149042
  derived and/or modified sequence opt3 from hemagglutinin__InfluenzaB__AGX22348

SEQ ID NO: 149590 - RNA, 1755 nt, Artificial Sequence
  derived and/or modified sequence opt3 from hemagglutinin__InfluenzaB__AGX22359
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacucagaugaagaaucuguacggcgauagcaacccucaaaaauuuacauccucagcgaacggggucaccacgcacuauguuagucagaucggaggcuucccagcacagaccgaggacggugggcucccccagagcggaagaauugugguagauuacauggugcaaaagccuaagaaaacaggcacuaucgucuaucagaggggcguguuacugccacagaagguuuggugcgccucugggcgguccaaagugauaaagggaucacuucccuugauuggugaagcugacugucugcaugagaaauacggcgggcuaaauaagagcaaaccguacuauaccggagaacacgccaaggcaaucggcaacugcccuauuugggucaagacaccccucaaacuggcuaaugguacuaaguaccgcccuccagccaaacuucugaaggagcgaggguuuuucggcgcgaucgccggauuuuuggagggcgggugggaaggaaugaucgcagguuggcacggcuauaccagucauggggcucacggaguggccguagcugccgaucucaaaucuacacaggaggcaauuaacaagauaaccaagaaucugaacuccuuaagcgaacuggagaucaaaaaucuccaaagacuuucgggcgccauggacgaacugcauaacgagauuuuggagcuagacgaaaagguugaugaccugagggcugauacuaucucuucccagauagagcucgcggugcugcuuucaaaugaagguauuaucaacagugaggacgaacaccuguuggcacucgagcggaaacugaagaaaauguuagggcccagcgccgucgauaucggcaauggauguuucgagacgaagcacaagugcaaccagacaugccuggaccguauugcugccggcaccuuuaaugcaggggaguucucccuaccaacuuuugauucucucaacaucaccgccgcuagccugaaugacgauggacuugacaaccauacaauuuugcuguacuauucaaccgccgcaaguucccucgcggugacucugaugcuugcuauauucaucgucuacauggugagccgcgauaacguuucuuguucaauuugccuguga

SEQ ID NO: 149591 - RNA, 1755 nt, Artificial Sequence; identical to SEQ ID NO: 149040
  derived and/or modified sequence opt3 from hemagglutinin__InfluenzaB__AGX22370

SEQ ID NO: 149592 - RNA, 1755 nt, Artificial Sequence
  derived and/or modified sequence opt3 from hemagglutinin__InfluenzaB__AGX22381
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugucgaaucuucugagggguuaugagaacauacgguugucaacucagaauguaaucgaugcagaaaaggccccugggggaccauaccgccucggcaccagcggcaguugccccaacgcuacauccaaaucuggguucuuugcaaccauggccugggcuguuccuaaggacaauaacaaaaaugccacgaacccacugacuguggaggucccguauauuuguacagaaggagaggaucagaucaccgugugggguuuccauagcgacaauaagacucagaugaaaaaccuguacggcgauuccaauccccaaaaguuuacaucaagugcgaacggggugaccacgcacuaugucagccagauuggaggcuucccugaccagaccgaggauggugggcucccacagucuggaagaaucguuguggacuacaugaugcaaaagcccggcaaaacaggcacuauaguauaucagcgcgggguguuacugccucagaaggucuggugcgcauccggacggucaaaagugauuaaggguagccuuccauugaucggcgaagccgauugucugcaugagaaauacgggggacuaaacaagaguaaacccuacuauaccggcgaacacgcuaaggccauugguaauugcccgaucuggguuaagacaccucucaaacuggcaaacgggacuaaguacaggcccccagcuaaacuucugaaggagcgaggcuuuuucggagccaucgcgggcuuuuuggaagggggaugggaagguaugauugccggcuggcacggguauaccucucauggagcacacggcguggcugucgccgcugaccucaaauccacacaggaggccauaaauaagaucaccaagaaccugaauagcuuaucggaacuggaggugaaaaaccuccaaagacuuucuggugcaauggacgaacugcauaaugagauuuuggagcuagaugaaaagguagacgaucugagggccgacacuaucuccucacagauagagcucgcuguucugcuuaguaacgaagggauuaucaauagcgaggaugaacaccuguuggcgcucgagcggaaacugaagaaaauguuaggcccuuccgcaguggacaucggaaacggcuguuucgagacgaagcacaagugcaaucagacaugccuggaucguauugccgcugggaccuuuaacgccggagaguucucucuacccacuuuugacagccucaauaucaccgcagccucacugaacgaugacggucuugauaaucauacaauuuugcuguacuauaguaccgcugccuccagccucgcagucacucugaugcuugcgauauucaucguguacauggucucucgcgacaacgugucauguaguauuugccuguga

SEQ ID NO: 149593 - RNA, 1755 nt, Artificial Sequence; identical to SEQ ID NO: 149039
  derived and/or modified sequence opt3 from hemagglutinin__InfluenzaB__AGX22392

SEQ ID NO: 149594 - RNA, 1755 nt, Artificial Sequence
  derived and/or modified sequence opt3 from hemagglutinin__InfluenzaB__AGX22403
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaggguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaauggacgaacugcauaaugagauuuuggagcuagaugaaaagguagacgaucugagggccgacacuaucucuucccagauagagcucgcuguucugcuuucaaacgaagggauuaucaauagugaggaugaacaccuguuggcgcucgagcggaaacugaagaaaauguuaggccccagcgcaguggacaucggaaacggcuguuucgagacgaagcacaagugcaaucagacaugccuggaucguauugccgcugggaccuuuaacgccggagacuucucccuaccaacuuuugauucucucaauaucaccgcagccagccugaacgacgauggucuugacaaucauacaauuuugcuguacuauucaaccgcugccaguucccucgcagucacucugaugcuugcgauauucaucguguacauggucagccgcgacaacgugucuuguucaauuugccuguga

SEQ ID NO: 149595 - RNA, 1755 nt, Artificial Sequence; identical to SEQ ID NO: 149039
  derived and/or modified sequence opt3 from hemagglutinin__InfluenzaB__AGX22414

SEQ ID NO: 149596 - RNA, 1755 nt, Artificial Sequence
  derived and/or modified sequence opt3 from hemagglutinin__InfluenzaB__AGX22425
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagauucagaugaaaaaccuguacggcgauagcaauccucaaaaguuuacuuccucagcgaacggggugacaacccacuaugucagucagaucggaggcuucccagaccagacggaggauggugggcucccccagagcggaagaauaguuguggacuacaugaugcaaaagccuggcaaaaccggcacaauuguauaucagaggggaguguuacugccacagaaggucuggugcgcaucugggcgguccaaagugaucaaggguucacuucccuugauuggcgaagccgauugucugcaugagaaauacgggggacuaaacaagagcaaaccguacuauacuggcgaacacgcuaaggccaucgguaauugcccuaucuggguuaagaccccucucaaacuggcaaacgggacaaaguaccgcccacccgcuaaacuucugaaggagcgaggcuuuuucggagccauugcgggcuuuuuggaagggggaugggaggguaugauagccggcuggcacggguauacuucccauggagcacacggcguggcugucgccgcugaccucaaaucuacccaggaggccaucaauaagauuacaaagaaccugaauaguuuaagcgaacuggaggugaaaaaccuccaaagacuuucgggugcaauggacgaacugcauaaugagaucuuggagcuagaugaaaagguagacgaucugagggccgacaccauaucuucccagauugagcucgcuguucugcuuucaaacgaagggaucaucaauagugaggaugaacaccuguuggcgcucgagcggaaacugaagaaaauguuaggccccagcgcaguggagauuggaaacggcuguuucgaaacuaagcacaagugcaaucagacgugccuggaccguaucgccgcugggacauuuaacgccggagaguucucccuaccaaccuuugauucucucaauauuacugcagccagccugaacgacgauggucuugacaaucauaccauauugcuguacuauucaacagcugccaguucccucgcagucacccugaugcuugcgaucuucauuguguacauggucagccgcgauaacgugucuuguucaaucugccuguga

SEQ ID NO: 149597 - RNA, 1755 nt, Artificial Sequence; identical to SEQ ID NO: 149040
  derived and/or modified sequence opt3 from hemagglutinin__InfluenzaB__AGX22436

SEQ ID NO: 149598 - RNA, 1755 nt, Artificial Sequence; identical to SEQ ID NO: 149040
  derived and/or modified sequence opt3 from hemagglutinin__InfluenzaB__AGX22445

SEQ ID NO: 149599 - RNA, 1755 nt, Artificial Sequence
  derived and/or modified sequence opt3 from hemagglutinin__InfluenzaB__AGX22456
augaaggccaucauugugcugcucauggucguuaccagcaacgcugacagaauaugcacaggcaucacuuccucuucaaguccccacgugguaaaaacggcaacccagggggaggugaaugucacaggagugauuccucuuacuaccacaccaaccaagagcuacuucgccaaccugaaagguacuaggacacggggcaaguuguguccggauugcuuaaauuguaccgaccuggauguugcgcuagggcgccccaugugcgugggaacgacuccuuccgcuaaagccucuauccuccaugaaguccgaccagugaccucgggcuguuuucccauuaugcacgaccguacaaagaucagacaacugccuaaccuucugagggguuaugagaauauacgguugucaacucagaacguaaucgaugcagaaaaggccccagggggacccuaccgccucggcaccagcggcaguugcccuaaugcuacauccaaaucuggguucuuugcaaccauggccugggcuguuccaaaggacaacaauaaaaacgccacgaauccgcugacuguggagguccccuauauuuguacagaaggagaggaucagaucaccgugugggguuuccauagcgacaacaagacucagaugaaaaaucuguacggcgauuccaacccucaaaaguuuacaucaagugcgaauggggugaccacgcacuaugucagccagauuggaggcuucccagaccagaccgaggauggugggcucccccagucuggaagaaucguuguggacuacaugaugcaaaagccuggcaaaacaggcacuauaguauaucagaggggaguguuacugccacagaaggucuggugcgcauccgggcggucaaaagugauuaaggguagccuucccuugaucggcgaagccgauugucugcaugagaaauacgggggacuaaacaagaguaaaccguacuauaccggcgaacacgcuaaggccauugguaacugcccuaucuggguuaagacaccccucaaacuggcaaaugggacuaaguaccgcccuccagcuaaacuucugaaggagcgaggcuuuuucggagccaucgcgggcuuuuuggaagggggaugggaagguaugauugccggcuggcacggguauaccucucauggagcacacggcguggcugucgccgcugaccucaaauccacacaggaggccauaaacaagaucaccaagaaucugaacagcuuaucggaacuggaggugaaaaaucuccaaagacuuucuggugcaauggacgaacugcauuccgagauuuuggagcuagaugaaaagguagacgaucugagggccgacacuaucucaagucagauagagcucgcuguucugcuuagcaacgaagggauuaucaauuccgaggaugaacaccuguuggcgcucgagcggaaacugaagaaaauguuaggccccucugcaguggacaucggaaacggcuguuucgagacgaagcacaagugcaaucagacaugccuggaucguauugccgcugggaccuuuaacgccggagaguucagccuaccaacuuuugacucacucaauaucaccgcagccagucugaacgaugacggucuugauaaucauacaauuuugcuguacuauuccaccgcugccagcucucucgcagucacucugaugcuugcgauauucaucguguacauugucucacgcgacaacgugaguuguagcaucugccuguga

SEQ ID NO: 149600 - RNA, 1755 nt, Artificial Sequence; identical to SEQ ID NO: 149039
  derived and/or modified sequence opt3 from hemagglutinin__InfluenzaB__AGX22467

SEQ ID NO: 149601 - RNA, 1755 nt, Artificial Sequence; identical to SEQ ID NO: 149039
  derived and/or modified sequence opt3 from hemagglutinin__InfluenzaB__AGX22478

SEQ ID NO: 149602 - RNA, 1755 nt, Artificial Sequence
  derived and/or modified sequence opt3 from hemagglutinin__InfluenzaB__AGX22489
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagucagcaaucgaugccgaaaaggcuccagggggacccuaccgccucggcaccagcggcaguugcccuaaugcaacauccaaaucuggguucuuugccaccauggcuugggccguaccaaaggacaacaauaaaaacgcgacgaauccgcugacuguugaggugcccuauauuuguacagaaggagaggaucagaucaccgucugggguuuccauagcgacaacaagacucagaugaaaaaucuguacggcgauuccaacccucaaaaguuuacaucaagugcaaauggggugaccacgcacuaugugagccagauuggaggcuucccaggucagaccgaggacgggggacucccccagucuggcagaaucgucguugauuacaugauacaaaagccuggcaaaacagggacuauuguguaucagaggggaguauuacugccacagaagguguggugcgccuccggucggucaaaagucaucaagggcagccuucccuugauuggggaagcugacugucugcaugagaaauacggaggccuaaacaagaguaaaccguacuauaccggugaacacgccaaggcaaucgggaacugcccuaucugggugaagacaccccucaaacuggcuaauggcacuaaguaccgcccuccagccaaacuucugaaggagcgaggauuuuucggcgcgauugccggguuuuuggagggagguugggaaggcaugauagcaggguggcacggauauaccucucauggcgcucacgguguugccguggcugccgaucucaaauccacacaggaggcaaucaacaagauuaccaagaaucugaacagcuuaucggaacuggaggucaaaaaucuccaaagacuuucuggggccauggacgaacugcauaacgagaucuuggagcuagacgaaaagguggaugaccugagggcugauacuauauccgcgcagauugagcucgcaguacugcuuucaaaugaaggcaucaucaacagugaggacgaacaccuguuggcccucgagcggaaacugaagaaaauguuaggacccagcgcuguugauauuggcaauggguguuucgagacgaagcacaagugcaaccagacaugccuggaccguaucgccgcaggaaccuuuaaugccggugaguucucccuaccaacuuuugauucucucaacauuaccgcugccagccugaaugacgauggccuugacaaccauacaauauugcuguacuauucaaccgcagcgaguucccucgcugugacucugaugcuugccaucuucauugucuacauggugagccgcgauaaugucucuuguucaaucugccuguga

SEQ ID NO: 149603 - RNA, 1755 nt, Artificial Sequence
  derived and/or modified sequence opt3 from hemagglutinin__InfluenzaB__AGX22500
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauauuuguacagaaggagaggaucagaucaccgugugggguuuccauucugacaacaaaacucagaugaagaaucuguacggcgauagcaacccucaaaaauuuacauccucagcgaacggggugaccacgcacuaugucagucagauuggaggcuucccagcacagaccgaggacggugggcucccccagagcggaagaaucauaguugauuacauggugcaaaagccuaggaagacaggcacuauuguauaucagcggggcguguuacugccacagaaagucuggugcgccucugggcgcuccaaggugaucaaaggaucacuucccuugauuggugaagcugacugucugcaugagaaguacggcgggcuaaauaaaagcaagccguacuauaccggagaacacgccaaagcaaucggcaacugcccuaucuggguuaagacaccccucaagcuggcuaaugguacuaaauaccgaccuccagccaaacuucugaaggagagaggguuuuucggcgcgauugccggauuuuuggagggcgggugggaaggaaugauagcagguuggcacggcuauaccagucauggggcucacggaguggccgucgcugccgaucucaagucuacacaggaggcaaucaacaaaauuaccaagaaucugaacuccuuaagcgaacuggaggugaagaaucuccaaaggcuuucgggcgccauggacgaacugcauaacgagaucuuggagcuagacgaaaaaguagaugaccugcgggcugauacuauaucuucccagauugagcucgcgguucugcuuucaaaugaagguaucaucaacagugaggacgaacaccuguuggcacucgagcguaagcugaaaaagauguuagggcccagcgccguggauauuggcaauggauguuucgagacgaaacacaagugcaaccagacaugccuggaccgcaucgcugccggcaccuuuaaugcaggggaguucucccuaccaacuuuugauucucucaacauuaccgccgcuagccugaaugacgauggacuugacaaccauacaauauugcuguacuauucaaccgucgccaguucccucgcagugacucugaugcuugcgaucuucauugucuacauggugagcagagauaacguuucuuguucaaucugccuguga

SEQ ID NO: 149604 - RNA, 1755 nt, Artificial Sequence; identical to SEQ ID NO: 149040
  derived and/or modified sequence opt3 from hemagglutinin__InfluenzaB__AGX22511

SEQ ID NO: 149605 - RNA, 1755 nt, Artificial Sequence
  derived and/or modified sequence opt3 from hemagglutinin__InfluenzaB__AGX22522
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccaagcacuaugucagucagauuggaggcuucccugaccagacggaggauggugggcucccacagagcggaagaaucguuguggacuacaugaugcaaaaacccggcaagaccggcacaauaguauaucagcgcgggguguuacugccucagaaagucuggugcgccucuggacgguccaaggugauuaaagguucacuuccauugaucggcgaagcugauugucugcaugagaaguacgggggacuaaacaaaagcaagcccuacuauacuggcgaacacgccaaggcaauugguaauugcccgaucuggguuaaaaccccucucaagcuggcuaacgggacaaaauacaggcccccagccaagcugcugaaagagcgaggcuuuuucggagcgaucgccggcuuuuuggaagggggaugggaagguaugauugcaggcuggcacggguauacaagucauggagcucacggcguggccgucgcugccgaccucaagucuacccaggaggcaauaaauaagaucacuaaaaaccuuaauuccuuaagcgaacuggaggugaagaaccuccaaagacuuucgggugccauggacgaacugcauaaugagauuuuggagcuagaugaaaaaguagacgaucugagggcugacaccaucucuucccagauagagcucgcgguucugcuuucaaacgaagggauuaucaauagugaggaugaacaccuguuggcacucgagcggaagcugaaaaagauguuaggcccuagcgccguggacaucggaaacggcuguuucgagacuaagcacaaaugcaaucagacgugccuggaucguauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgcgacaacgugucuuguucaauuugccuguga

SEQ ID NO: 149606 - RNA, 1755 nt, Artificial Sequence; identical to SEQ ID NO: 148442
  derived and/or modified sequence opt3 from hemagglutinin__InfluenzaB__AGX22533

SEQ ID NO: 149607 - RNA, 1755 nt, Artificial Sequence; identical to SEQ ID NO: 149054
  derived and/or modified sequence opt3 from hemagglutinin__InfluenzaB__AGX22566

SEQ ID NO: 149608 - RNA, 1755 nt, Artificial Sequence; identical to SEQ ID NO: 149040
  derived and/or modified sequence opt3 from hemagglutinin__InfluenzaB__AGX22577

SEQ ID NO: 149609 - RNA, 1755 nt, Artificial Sequence; identical to SEQ ID NO: 149054
  derived and/or modified sequence opt3 from hemagglutinin__InfluenzaB__AGX22588

SEQ ID NO: 149610 - RNA, 1755 nt, Artificial Sequence; identical to SEQ ID NO: 148442
  derived and/or modified sequence opt3 from hemagglutinin__InfluenzaB__AGX22599

SEQ ID NO: 149611 - RNA, 1755 nt, Artificial Sequence
  derived and/or modified sequence opt3 from hemagglutinin__InfluenzaB__AGX22610
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauccuaauccacaaaaguuuacaagcuccgcgaacggggugaccacgcacuaugucucacagauuggaggcuuccccgaccagaccgaggauggugggcucccucagaguggaagaaucguuguggacuacaugaugcaaaagccaggcaaaacaggcacuauaguauaucagaggggaguguuacugccccagaaggucuggugcgcaagcgggcggucuaaagugauuaaggguucccuuccguugaucggcgaagccgauugucugcaugagaaauacgggggacuaaacaagucaaaaccuuacuauaccggcgaacacgcuaaggccauugguaauugccccaucuggguuaagacaccacucaaacuggcaaacgggacuaaguaccgcccucccgcuaaacuucugaaggagcgaggcuuuuucggagccaucgcgggcuuuuuggaagggggaugggaagguaugauugccggcuggcacggguauaccagccauggagcacacggcguggcugucgccgcugaccucaaaaguacacaggaggccauaaauaagaucaccaagaacuuaaauucucuguccgaacuggaggugaaaaaccuccaaagacuuagcggugcaauggacgaacugcauaaugagauuuuggagcuagaugaaaagguagacgaucugagggccgacacuaucucgucucagauagagcucgcuguucugcuuuccaacgaagggauuaucaauucagaggaugaacaccuguuggcgcucgagcggaaacugaagaaaauguuaggcccaagugcaguggacaucggaaacggcuguuucgagacgaagcacaagugcaaucagacaugccuggaucguauugccgcugggaccuuuaacgccggagaguucagccuacccacuuuugacucccucaauaucaccgcagccucucugaacgaugacggucuugauaaucauacaauuuugcuguacuauagcaccgcugccucaagucucgcagucacucugaugcuugcgauauucaucguguacauggucucccgcgacaacgugagcuguucuauuugccuguga

SEQ ID NO: 149612 - RNA, 1755 nt, Artificial Sequence
  derived and/or modified sequence opt3 from hemagglutinin__InfluenzaB__AGX22621
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacaggaggugaagaucagaucaccguguggggcuuccauucugacaauaagacucagaugaaaaaccuguacggggauagcaauccccaaaaguuuacauccucagcaaacggagugaccacgcacuaugucagucagauuggcgguuucccugaccagaccgaggaugggggacucccacagagcggcagaaucguuguggacuacaugaugcaaaagcccggcaaaacagggacuauaguauaucagaggggaguguuacugccucagaaggucuggugcgccucuggucgguccaaagugauuaagggcucacuuccauugaucggggaggcugauugucugcaugaaaaauacggaggccuaaacaagagcaaacccuacuauaccggugagcacgccaaggcaauugggaauugcccgaucuggguuaagacaccucucaaacuggcuaacggcacuaaguaccgacccccagccaaacuucugaaggaacgcggauuuuucggcgcgaucgccggguuuuuggagggagguugggagggcaugauugcaggguggcacggauauaccagucauggcgcucacgguguggccgucgcugccgaccucaaaucuacacaggaagcaauaaauaagaucaccaagaacuuaaauucccugagcgagcuggaagugaaaaaccuccaaagacuuucgggggccauggacgagcugcauaaugaaauuuuggagcuagaugagaagguagacgaucugagggcugacacuaucucuucccagauagaacucgcgguucugcuuucaaacgagggcauuaucaauagugaagaugagcaccuguuggcacucgaacggaaacugaagaaaauguuaggaccuagcgccguggacaucggcaacggguguuucgagacgaagcacaagugcaaucagacaugccuggaucguauugcugccggaaccuuuaacgccggugaguucucccuacccacuuuugacucucucaauaucaccgcagcuagccugaacgaugacggccuugauaaucauacaauuuugcuguacuauucaaccgccgcaaguucccucgcggucacucugaugcuugcuauauucaucguguacauggucagccgcgacaacgugucuuguucaauuugccuguga

SEQ ID NO: 149613 - RNA, 1755 nt, Artificial Sequence; identical to SEQ ID NO: 148442
  derived and/or modified sequence opt3 from hemagglutinin__InfluenzaB__AGX22632

SEQ ID NO: 149614 - RNA, 1755 nt, Artificial Sequence
  derived and/or modified sequence opt3 from hemagglutinin__InfluenzaB__AGX22643
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgauccagaauguaauugaugccgaaaaggcuccugggggaccauaccgccucggcacuucaggcagcugccccaacgcaaccaguaaauccggguucuuugccacaauggcuugggccguuccuaaggacaauaacaaaaaugcgaccaacccacugacgguggaggucccguauaucuguacugaaggagaggaucagauuacagugugggguuuccauucugacaauaagacccagaugaaaaaccuguacggcgauagcaauccccaaaaguuuacuuccucagcaaacggggugacaacccacuaugucagucagaucggaggcuucccugaccagacggaggauggugggcucccacagagcggaagaauaguuguggacuacaugaugcaaaagcccggcaaaaccggcacaauuguauaucagcgcgggguguuacugccucagaaggucuggugcgccucuggacgguccaaagugaucaaggguucacuuccauugauuggcgaagcugauugucugcaugagaaauacgggggacuaaacaagagcaaacccuacuauacuggcgaacacgccaaggcaaucgguaauugcccgaucuggguuaagaccccucucaaacuggcuaacgggacaaaguacaggcccccagccaaacuucugaaggagcgaggcuuuuucggagcgauugccggcuuuuuggaagggggaugggaagguaugauagcaggcuggcacggguauacuucccauggagcucacggcguggccgucgcugccgaccucaaaucuacccaggaggcaaucaauaagauuacaaagaaccugaauaguuuaagcgaacuggaggugaaaaaccuccaaagacuuucgggugccauggacgaacugcauaaugagaucuuggagcuagaugaaaagguagacgaucugagggcugacaccauaucuucccagauugagcucgcgguucugcuuucaaacgaagggaucaucaauagugaggaugaacaccuguuggcacucgagcggaaacugaagaaaauguuaggcccuagcgccguggacauuggaaacggcuguuucgagacuaagcacaagugcaaucagacgugccuggaucguaucgcugccgggacauuuaacgcaggagaguucucccuacccaccuuugacucucucaauauuacugccgcuagccugaacgaugacggucuugauaaucauaccauauugcuguacuauucaacagccgcaaguucccucgcggucacccugaugcuugcuaucuucauuguguacauggucagccgcgacaacgugucuuguucaaucugccuguga

SEQ ID NO: 149615 - RNA, 1755 nt, Artificial Sequence
  derived and/or modified sequence opt3 from hemagglutinin__InfluenzaB__AGX22654
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagcgcgggguguuacugccucagaaggucuggugcgccucuggacgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucucaaacuggcuaacgggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaagaacuuaaauucccugagcgaacuggaggugaaaaaccuccaaagacuuucgggugccauggacgaacugcauucugagauuuuggagcuagaugaaaagguagacgaucugagggcugacacuaucuccucacagauagagcucgcgguucugcuuaguaaugaagggauuaucaacagcgaggaugaacaccuguuggcacucgagcggaaacugaagaaaauguuaggcccuuccgccguggacaucggaaauggcuguuucgagacgaagcacaagugcaaccagacaugccuggaucguauugcugccgggaccuuuaaugcaggagaguucucucuacccacuuuugacagccucaacaucaccgccgcuucacugaaugaugacggucuugauaaccauacaauuuugcuguacuauaguaccgccgcauccagccucgcggucacucugaugcuugcuauauucaucguguacauggucucucgcgacaaugugucauguaguauuugccuguga

SEQ ID NO: 149616 - RNA, 1755 nt, Artificial Sequence; identical to SEQ ID NO: 149054
  derived and/or modified sequence opt3 from hemagglutinin__InfluenzaB__AGX22665

SEQ ID NO: 149617 - RNA, 1755 nt, Artificial Sequence; identical to SEQ ID NO: 149054
  derived and/or modified sequence opt3 from hemagglutinin__InfluenzaB__AGX22676

SEQ ID NO: 149618 - RNA, 1755 nt, Artificial Sequence; identical to SEQ ID NO: 148442
  derived and/or modified sequence opt3 from hemagglutinin__InfluenzaB__AGX22687

SEQ ID NO: 149619 - RNA, 1755 nt, Artificial Sequence; identical to SEQ ID NO: 149054
  derived and/or modified sequence opt3 from hemagglutinin__InfluenzaB__AGX22698

SEQ ID NO: 149620 - RNA, 1755 nt, Artificial Sequence
  derived and/or modified sequence opt3 from hemagglutinin__InfluenzaB__AGX22709
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccgagaaaacaggcacuauaguauaucagaggggcguguuacugccucagaaggucuggugcgccucugggcgguccaaagugauuaagggaucacuuccauugaucggugaagcugauugucugcaugaaaaauacggcgggcuaaacaagagcaaacccuacuauaccggagagcacgccaaggcaauuggcaauugcccgaucuggguuaagacaccucucaaacuggcuaacgguacuaaguaccgacccccagccaaacuucugaaggagcgcggguuuuucggcgcgaucgccggauuuuuggaaggcgggugggagggaaugauugcagguuggcacggcuauaccagucauggggcucacggaguggccgucgcugccgaccucaaaucuacacaggaagcaauaaauaagaucaccaagaacuuaaauucccugagcgagcuggaagugaaaaaccuccaaagacuuucgggcgccauggacgagcugcauaaugagauuuuggaacuagaugagaagguagacgaucugagggcugacacuaucucuucccagauagaacucgcgguucugcuuucaaacgaggguauuaucaauagugaagaugagcaccuguuggcacucgagcggaaacugaagaaaauguuagggccuagcgccguggacaucggcaacggauguuucgaaacgaagcacaagugcaaucagacaugccuggaucguauugcugccggcaccuuuaacgcaggggaguucucccuacccacuuuugacucucucaauaucaccgccgcuagccugaacgaugacggacuugauaaucauacaauuuugcuguacuauucaaccgccgcaaguucccucgcggucacucugaugcuugcuauauucaucguguacauggucagccgcgacaacgugucuuguucaauuugccuguga

SEQ ID NO: 149621 - RNA, 1755 nt, Artificial Sequence
  derived and/or modified sequence opt3 from hemagglutinin__InfluenzaB__AGX22720
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggcaaccacgcacuaugugagucagauuggaggcuucccagaccagaccgaggauggugggcucccccagagcggaagaaucgucguugacuacaugaugcaaaagccuggcaaaacaggcacuauaguguaucagaggggaguauuacugccacagaagguguggugcgccucugggcgguccaaagucauuaaggguucacuucccuugaucggcgaagcugauugucugcaugagaaauacgggggacuaaacaagagcaaaccguacuauaccggcgaacacgccaaggcaauugguaauugcccuaucugggugaagacaccccucaaacuggcuaacgggacuaaguaccgcccuccagccaaacuucugaaggagcgaggcuuuuucggagcgaucgccggcuuuuuggaagggggaugggaagguaugauugcaggcuggcacggguauaccagucauggagcucacggcguugccguggcugccgaccucaaaucuacacaggaggcaauaaauaagaucaccaagaacuuaaauucccugagcgaacuggaggucaaaaaccuccaaagacuuucgggugccauggacgaacugcauaaugagauuuuggagcuagaugaaaagguggacgaucugagggcugacacuaucucuucccagauagagcucgcgguacugcuuucaaacgaagggauuaucaauagugaggaugaacaccuguuggcacucgagcggaaacugaagaaaauguuaggccccagcgccguugacaucggaaacggcuguuucgagacgaagcacaagugcaaucagacaugccuggaucguauugcugccgggaccuuuaacgcaggagaguucucccuaccaacuuuugacucucucaauaucaccgccgcuagccugaacgaugacggucuugauaaucauacaauuuugcuguacuauucaaccgccgcaaguucccucgcggugacucugaugcuugcuauauucaucgucuacauggugagccgcgacaacgucucuuguucaauuugccuguga

SEQ ID NO: 149622 - RNA, 1755 nt, Artificial Sequence; identical to SEQ ID NO: 149054
  derived and/or modified sequence opt3 from hemagglutinin__InfluenzaB__AGX22731

SEQ ID NO: 149623 - RNA, 1755 nt, Artificial Sequence; identical to SEQ ID NO: 149615
  derived and/or modified sequence opt3 from hemagglutinin__InfluenzaB__AGX22742

SEQ ID NO: 149624 - RNA, 1755 nt, Artificial Sequence
  derived and/or modified sequence opt3 from hemagglutinin__InfluenzaB__AGX22753
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccagccaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacuggccaaucuucugagggguuaugagaacauacgguugucgacacagaauguaaucgaugcugaaaaggcaccugggggaccauaccgccucggcacuucaggcagcugccccaacgccaccaguaaauccggguucuuugcuacaauggccugggcgguuccuaaggacaauaacaaaaaugcaaccaacccacugacgguggaggucccguauauuuguaaggaaggagaggaucagaucacugugugggguuuccauucugacaauaaaacacagaugaagaaccuguacggcgauagcaauccccaaaaguuuaccuccucagccaacggggugacuacacacuaugucagucagauuggaggcuucccugaccagaccgaggauggugggcucccacagagcggaagaaucguuguggacuacaugauacaaaaacccggcaagacgggcaccauuguauaucagcgcgggguguuacugccucagaaagucuggugcgcuucuggacgguccaaggugaucaaagguucacuuccauugauuggcgaagccgauugucugcaugagaaguacgggggacuaaacaaaagcaagcccuacuauacaggcgaacacgcaaaggcuaucgguaauugcccgaucuggguuaaaacuccucucaagcuggccaacgggaccaaauacaggcccccagcgaagcugcugaaagagcgaggcuuuuucggagccauugcaggcuuuuuggaagggggaugggaagguaugauagcuggcuggcacggguauacaagucauggagcccacggcguggcugucgccgcagaccucaagucuacucaggaggccaucaauaagauuaccaaaaaccuuaauuccuuaagcgaacuggaggugaagaaccuccaaagacuuucgggugcuauggacgaacugcauaaugagaucuuggagcuagaugaaaaaguagacgaucugagggcggacacaauaucuucccagauugagcucgcaguucugcuuucaaacgaagggaucaucaauagugaggaugaacaccuguuggcccucgagcggaagcugaaaaagauguuaggcccuagcgcuguggacauuggaaacggcuguuucgagaccaagcacaaaugcaaucagacuugccuggaucguaucgccgcagggacguuuaacgccggagaguucucccuacccacauuugacucucucaauauuaccgcugccagccugaacgaugacggucuugauaaucauacuauauugcuguacuauucaaccgcagcgaguucccucgcugucacacugaugcuugccaucuucauuguguacauggucagccgcgacaacgugucuuguucaaucugccuguga

SEQ ID NO: 149625 - RNA, 1755 nt, Artificial Sequence
  derived and/or modified sequence opt3 from hemagglutinin__InfluenzaB__AGX22764
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcaaacggggugacaacccacuaugucagucagauuggaggcuucccugaccagacggaggauggugggcucccacagagcggaagaaucguuguggacuacaugauacaaaaacccggcaagaccggcacaauuguauaucagcgcgggguguuacugccucagaaagucuggugcgccucuggacgguccaaggugaucaaagguucacuuccauugauuggcgaagcugauugucugcaugagaaguacgggggacuaaacaaaagcaagcccuacuauacuggcgaccacgccaaggcaaucgguaauugcccgaucuggguuaaaaccccucucaagcuggcuaacgggacaaaauacaggcccccagccaagcugcugaaagaacgaggcuuuuucggagcgauugccggcuuuuuggaagggggaugggaggguaugauagcaggcuggcacggguauacaagucauggagcucacggcguggccgucgcugccgaccucaagucuacccaggaggcaaucaauaagauuacuaaaaaccuuaauuccuuaagcgagcuggaagugaagaaccuccaaagacuuucgggugccauggaugagcugcauaaugaaaucuuggagcuagacgagaaaguagaugaccugagggcugauaccauaucuucccagauugaacucgcgguucugcuuucaaacgaggggaucaucaauagugaagacgagcaccuguuggcacucgaacggaagcugaaaaagauguuaggcccuagcgccguggauauuggaaacggcuguuucgagacuaagcacaaaugcaaucagacgugccuggaccguaucgcugccgggacauuuaacgcaggagaguucucccuacccaccuuugauucucucaauauuacugccgcuagccugaacgacgauggucuugacaaucauaccauauugcuguacuauucaacagccgcaaguucccucgcggucacccugaugcuugcuaucuucauuguguacauggucagccgcgacaacgugucuuguucaaucugccuguga

SEQ ID NO: 149626 - RNA, 1755 nt, Artificial Sequence
  derived and/or modified sequence opt3 from hemagglutinin__InfluenzaB__AGX22775
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggaggcuucccagaccagaccgaggauggugggcucccccagagcggaagaaucguuguggacuacaugaugcaaaagccuggcaaaacaggcacuauaguauaucagaggggaguguuacugccacagaaggucuggugcgcaucugggcgguccaaagugauuaaggguucacuucccuugaucggcgaagccgauugucugcaugagaaauacgggggacuaaacaagagcaaaccguacuauaccggcgaacacgcuaaggccauugguaauugcccuaucuggguuaagacaccccucaaacuggcaaacgggacuaaguaccgcccuccagcuaaacuucugaaggagcgaggcuuuuucggagccaucgcgggcuuuuuggaagggggaugggaggguaugauugccggcuggcacggguauaccagucauggagcacacggcguggcugucgccgcugaccucaaaucuacacaggaggccauaaauaagaucaccaagaacuuaaauucccugagcgaacuggaggugaaaaaccuccaaagacuuucgggugcaauggacgaacugcauaaugagauuuuggagcuagaugaaaagguagacgaucugagggccgacacuaucucuucccagauagagcucgcuguucugcuuucaaacgaagggauuaucaauagugaggaugaacaccuguuggcgcucgagcggcgucugaaaaagauguuaggccccagcgcaguggagaucggaaacggcuguuucgaaacgaaacacaagugcaaucagacaugccuggaccgcauugccgcugggaccuuuaacgccggagaguucucccuaccaacuuuugauucucucaauaucaccgcagccagccugaacgacgauggucuugacaaucauacaauuuugcuguacuauucaaccgcugccaguucccucgcagucacucugaugcuugcgauauucaucguguacauggucagcagagauaacgugucuuguucaauuugccuguga

SEQ ID NO: 149627 - RNA, 1755 nt, Artificial Sequence; identical to SEQ ID NO: 149054
  derived and/or modified sequence opt3 from hemagglutinin__InfluenzaB__AGX22786

SEQ ID NO: 149628 - RNA, 1755 nt, Artificial Sequence
  derived and/or modified sequence opt3 from hemagglutinin__InfluenzaB__AGX22797
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcaaacggggugacaacccacuaugucagucagauuggaggcuucccugaccagacggaggauggugggcucccacagagcggaagaaucguuguggacuacaugauacaaaaacccggcaagaccggcacaauuguauaucagcgcgggguguuauuuccucagaaagucuggugcgccucuggacgguccaaggugaucaaagguucacugccacuuauuggcgaagcugauuguuugcaugagaaguacgggggacugaacaaaagcaagcccuacuauacuggcgaacacgccaaggcaaucgguaauugcccgaucuggguuaaaaccccucuaaagcucgcuaacgggacaaaauacaggcccccagccaagcugcuuaaagagcgaggcuucuuuggagcgauugccggcuuccuggaagggggaugggaggguaugauagcaggcuggcacggguauacaagucauggagcucacggcguggccgucgcugccgacuugaagucuacccaggaggcaaucaauaagauuacuaaaaaccucaauucccugagcgaauuagaggugaagaaccugcaaagacucucgggugccauggacgaacuucauaaugagauccuggaguuggaugaaaaaguagacgaucuaagggcugacaccauaucuucccagauugagcuggcgguucuccugucaaacgaagggaucaucaauagugaggaugaacaccuucuggcauuggagcggaagcucaaaaagaugcugggcccuagcgccguggacauuggaaacggcuguuuugagacuaagcacaaaugcaaucagacgugcuuagaucguaucgcugccgggacauucaacgcaggagaauuuucccugcccaccuucgacucucuaaauauuacugccgcuagccucaacgaugacggucuggauaaucauaccauacuuuuguacuauucaacagccgcaaguucccuggcggucacccucaugcuggcuaucuucauuguguacauggucagccgcgacaacgugucuuguucaaucugccuuuga

SEQ ID NO: 149629 - RNA, 1755 nt, Artificial Sequence; identical to SEQ ID NO: 149054
  derived and/or modified sequence opt3 from hemagglutinin__InfluenzaB__AGX22808

SEQ ID NO: 149630 - RNA, 1755 nt, Artificial Sequence; identical to SEQ ID NO: 149054
  derived and/or modified sequence opt3 from hemagglutinin__InfluenzaB__AGX22819

SEQ ID NO: 149631 - RNA, 1755 nt, Artificial Sequence; identical to SEQ ID NO: 149054
  derived and/or modified sequence opt3 from hemagglutinin__InfluenzaB__AGX22830

SEQ ID NO: 149632 - RNA, 1755 nt, Artificial Sequence
  derived and/or modified sequence opt3 from hemagglutinin__InfluenzaB__AGX22841
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcagacggggugacaacccacuaugucagucagauuggaggcuucccugaucagacggaggacggugggcucccacagagcggaagaaucguuguggauuacaugauacaaaaacccggcaagaccggcacaauuguauaucagcgcgggguguuacugccucagaaagucuggugcgccucuggacgguccaaggugaucaaagguucacuuccauugauuggcgaagcugacugucugcaugagaaguacgggggacuaaacaaaagcaagcccuacuauacuggcgaacacgccaaggcaaucgguaacugcccgaucuggguuaaaaccccucucaagcuggcuaaugggacaaaauacaggcccccagccaaacuucugaaggagcgaggcuuuuucggagcgauugccggcuuuuuggaagggggaugggaagguaugauagcaggcuggcacggguauacaagucauggagcucacggcguggccgucgcugccgaccucaagucuacccaggaggcaaucaacaagauuacuaaaaaucugaacuccuuaagcgaacuggaggugaagaaucuccaaagacuuucgggugccauggaugaacugcauaacgagaucuuggagcuagacgaaaaaguagaugaccugagggcugauaccauaucuucccagauugagcucgcgguucugcuuucaaaugaagggaucaucaacagugaggacgaacaccuguuggcacucgagcggaagcugaaaaagauguuaggcccuagcgccguggauauuggaaauggcuguuucgagacuaagcacaaaugcaaccagacgugccuggaccguaucgcugccgggacauuuaaugcaggagaguucucccuacccaccuuugauucucucaacauuacugccgcuagccugaaugacgauggucuugacaaccauaccauauugcuguacuauucaacagccgcaaguucccucgcggucacccugaugcuugcuaucuucauuguguacauggucagccgcgacaaugugucuuguucaaucugccuguga

SEQ ID NO: 149633 - RNA, 1755 nt, Artificial Sequence; identical to SEQ ID NO: 148442
  derived and/or modified sequence opt3 from hemagglutinin__InfluenzaB__AGX22852

SEQ ID NO: 149634 - RNA, 1755 nt, Artificial Sequence; identical to SEQ ID NO: 149054
  derived and/or modified sequence opt3 from hemagglutinin__InfluenzaB__AGX22863

SEQ ID NO: 149635 - RNA, 1755 nt, Artificial Sequence; identical to SEQ ID NO: 149054
  derived and/or modified sequence opt3 from hemagglutinin__InfluenzaB__AGX22874

SEQ ID NO: 149636 - RNA, 1755 nt, Artificial Sequence; identical to SEQ ID NO: 148442
  derived and/or modified sequence opt3 from hemagglutinin__InfluenzaB__AGX22885

SEQ ID NO: 149637 - RNA, 1755 nt, Artificial Sequence; identical to SEQ ID NO: 149615
  derived and/or modified sequence opt3 from hemagglutinin__InfluenzaB__AGX22896

SEQ ID NO: 149638 - RNA, 1755 nt, Artificial Sequence
  derived and/or modified sequence opt3 from hemagglutinin__InfluenzaB__AGX22907
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagcgcgggguguuacugccucagaaggucuggugcgccucuggacgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucucaaacuggcuaacgggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaagaacuuaaauucccugagcgaacuggaggugaaaaaccuccaaagacuuucgggugccauggacgaacugcauaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccuagcgccguggacaucggaaacggcuguuucgagacgaagcacaagugcaaucagacaugccuggaucguauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagccgcgacucugugucauguaguauuugccuguga

SEQ ID NO: 149639 - RNA, 1755 nt, Artificial Sequence; identical to SEQ ID NO: 148442
  derived and/or modified sequence opt3 from hemagglutinin__InfluenzaB__AGX22918

SEQ ID NO: 149640 - RNA, 1755 nt, Artificial Sequence; identical to SEQ ID NO: 148442
  derived and/or modified sequence opt3 from hemagglutinin__InfluenzaB__AGX22929

SEQ ID NO: 149641 - RNA, 1755 nt, Artificial Sequence; identical to SEQ ID NO: 149054
  derived and/or modified sequence opt3 from hemagglutinin__InfluenzaB__AGX22940

SEQ ID NO: 149642 - RNA, 1755 nt, Artificial Sequence; identical to SEQ ID NO: 148442
  derived and/or modified sequence opt3 from hemagglutinin__InfluenzaB__AGX22951

SEQ ID NO: 149643 - RNA, 1755 nt, Artificial Sequence; identical to SEQ ID NO: 148442
  derived and/or modified sequence opt3 from hemagglutinin__InfluenzaB__AGX22962

SEQ ID NO: 149644 - RNA, 1755 nt, Artificial Sequence; identical to SEQ ID NO: 148442
  derived and/or modified sequence opt3 from hemagglutinin__InfluenzaB__AGX22973

SEQ ID NO: 149645 - RNA, 1755 nt, Artificial Sequence; identical to SEQ ID NO: 148442
  derived and/or modified sequence opt3 from hemagglutinin__InfluenzaB__AGX22984

SEQ ID NO: 149646 - RNA, 1755 nt, Artificial Sequence; identical to SEQ ID NO: 148442
  derived and/or modified sequence opt3 from hemagglutinin__InfluenzaB__AGX22995

SEQ ID NO: 149647 - RNA, 1755 nt, Artificial Sequence; identical to SEQ ID NO: 148442
  derived and/or modified sequence opt3 from hemagglutinin__InfluenzaB__AGX23006

SEQ ID NO: 149648 - RNA, 1755 nt, Artificial Sequence
  derived and/or modified sequence opt3 from hemagglutinin__InfluenzaB__AGX23017
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaauucgaccagucaccucuggcuguuuucccaucaugcacgaccguacaaagauaagacaacuggcaaaucuucugagggguuaugagaacauccgguugucgacucagaaugugauugaugccgaaaaggcuccugggggaccauaccgccucggcaccucaggcagcugccccaacgcaacaaguaaauccggguucuuugccaccauggcuugggccguaccuaaggacaauaacaaaaaugcgacgaacccacugacuguugaggugccguauaucuguacagaaggagaggaucagauuaccgucugggguuuccauucugacaauaagacucagaugaaaaaccuguacggcgauagcaauccccaaaaguuuacauccucagcaaacggggugaccacgcacuaugugagucagaucggaggcuucccugaccagaccgaggauggugggcucccacagagcggaagaauagucguugacuacaugaugcaaaagcccggcaaaacaggcacuauuguguaucagcgcgggguauuacugccucagaagguguggugcgccucuggacgguccaaagucaucaaggguucacuuccauugauuggcgaagcugauugucugcaugagaaauacgggggacuaaacaagagcaaacccuacuauaccggcgaacacgccaaggcaaucgguaauugcccgaucugggugaagacaccucucaaacuggcuaacgggacuaaguacaggcccccagccaaacuucugaaggagcgaggcuuuuucggagcgauugccggcuuuuuggaagggggaugggaagguaugauagcaggcuggcacggguauaccagucauggagcucacggcguugccguggcugccgaccucaaaucuacacaggaggcaaucaauaagauuaccaagaacuuaaauucccugagcgaacuggaggucaaaaaccuccaaagacuuucgggugccauggacgaacugcauaaugagaucuuggagcuagaugaaaagguggacgaucugagggcugacacuauaucuucccagauugagcucgcgguacugcuuucaaacgaagggaucaucaauagugaggaugaacaccuguuggcacucgagcggaaacugaagaaaauguuaggcccuagcgccguugacauuggaaacggcuguuucgagacgaagcacaagugcaaucagacaugccuggaucguaucgcugccgggaccuuuaacgcaggagaguucucccuacccacuuuugacucucucaauauuaccgccgcuagccugaacgaugacggucuugauaaucauacaauauugcuguacuauucaaccgccgcaaguucccucgcggugacucugaugcuugcuaucuucauugucuacauggugagccgcgacaacgucucuuguucaaucugccuguga

SEQ ID NO: 149649 - RNA, 1755 nt, Artificial Sequence
  derived and/or modified sequence opt3 from hemagglutinin__InfluenzaB__AGX23028
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauacaagcucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaagaaccuguacggcgauagcaauccccaaaaauuuacauccucagcaaacggggugaccacgcacuaugucagucagauuggaggcuucccugaccagaccgaggauggugggcucccacagagcggacggaucguuguggacuacaugaugcaaaagcccggcaaaacaggcacuauaguauaucagcgcgggguguuacugccucagaaggucuggugcgccucuggaagauccaaagugauuaaggguucacuuccauugaucggcgaagcugauugucugcaugagaaauacgggggacuaaacaagagcaagcccuacuauaccggcgaacacgccaaagcaauugguaauugcccgaucuggguuaagacaccucucaaacuggcuaacgggacuaaguacaggcccccagccaaacuucugaaggagcggggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaaaaucaccaagaacuuaaauucccugagcgaacuggaggugaaaaaccuccaacgccuuucgggugccauggacgaacugcauaaugagauuuuggagcuagaugaaaagguagacgaucugcgagcugacacuaucucuucccagauagagcucgcgguucugcuuucaaacgaagggauuaucaauagugaggaugaacaccuguuggcacucgagagaaaacugaagaagauguuaggcccuagcgccguggacaucggaaacggcuguuucgagacgaaacacaagugcaaucagacaugccuggauaggauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagccgggacaacgugucuuguucaauuugccuguga

SEQ ID NO: 149650 - RNA, 1755 nt, Artificial Sequence; identical to SEQ ID NO: 148442
  derived and/or modified sequence opt3 from hemagglutinin__InfluenzaB__AGX23039

SEQ ID NO: 149651 - RNA, 1755 nt, Artificial Sequence
  derived and/or modified sequence opt3 from hemagglutinin__InfluenzaB__AGX23050
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaagucucuccagugaccucgggcuguuuucccauuaugcacgaccgaacaaagauccgucaacuggcaaaucuucugagagguuaugagaacauaagguugucaacucagaauguaaucgaugccgaaaaggcuccugggggaccauaccggcucggcaccagcggcaguugccccaacgcaacauccaaaucuggguucuuugccaccauggcuugggccguuccuaaggacaauaacaaaaaugcgacgaacccacugacuguggaggucccguauauuuguacagaaggagaggaucagaucaccgugugggguuuccauagcgacaauaagacucagaugaaaaaccuguacggcgauuccaauccccaaaaguuuacaucaagugcaaacggggugaccacgcacuaugucagccagauuggaggcuucccugaccagaccgaggauggugggcucccacagucuggacgcaucguuguggacuacaugaugcaaaagcccggcaaaacaggcacuauaguauaucagagagggguguuacugccucagaaggucuggugcgccuccggaaggucaaaagugauuaaggguagccuuccauugaucggcgaagcugauugucugcaugagaaauacgggggacuaaacaagaguaaacccuacuauaccggcgaacacgccaaggcaauugguaauugcccgaucuggguuaagacaccucuccggcuggcuaacgggacuaaauaccgacccccagccaaacuucugaaggagcgcggcuuuuucggagcgaucgccggcuuuuuggaagggggaugggaagguaugauugcaggcuggcacggguauaccucucauggagcucacggcguggccgucgcugccgaccucaaguccacacaggaggcaauaaauaaaaucaccaagaaccugaauagcuuaucggaacuggaggugaagaaccuccaaagacuuucuggugccauggacgaacugcauaaugagauuuuggagcuagaugaaaaaguagacgaucugagggcugacacuaucuccucacagauagagcucgcgguucugcuuaguaacgaagggauuaucaauagcgaggaugaacaccuguuggcacucgagcggaagcugaaaaagauguuaggcccuuccgccguggacaucggaaacggcuguuucgagacgaaacacaagugcaaucagacaugccuggaucguauugcugccgggaccuuuaacgcaggagaguucucucuacccacuuuugacagccucaauaucaccgccgcuucacugaacgaugacggucuugauaaucauacaauuuugcuguacuauaguaccgccgcauccagccucgcggucacucugaugcuugcuauauucaucguguacauggucucucgcgacaacgugucauguaguauuugccuguga

SEQ ID NO: 149652 - RNA, 1755 nt, Artificial Sequence
  derived and/or modified sequence opt3 from hemagglutinin__InfluenzaB__AGX23061
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagaggggaguguuacugccucagaaggucuggugcgccucugggcgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucuccgccuggcuaacgggacuaaauaccgacccccagccaagcugcugaaagagagaggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaaaaucaccaagaaccuuaauuccuuaagcgaacuggaggugaagaaccuccaaaggcuuucgggugccauggacgaacugcauaaugagauuuuggagcuagaugaaaaaguagacgaucugcgggcugacacuaucucuucccagauagagcucgcgguucugcuuucaaacgaagggauuaucaauagugaggaugaacaccuguuggcacucgagcguaagcugaaaaagauguuaggcccuagcgccguggacaucggaaacggcuguuucgagacgaaacacaagugcaaucagacaugccuggaucgcauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagcagagacaacgugucuuguucaauuugccuguga

SEQ ID NO: 149653 - RNA, 1755 nt, Artificial Sequence; identical to SEQ ID NO: 148442
  derived and/or modified sequence opt3 from hemagglutinin__InfluenzaB__AGX23072

SEQ ID NO: 149654 - RNA, 1755 nt, Artificial Sequence; identical to SEQ ID NO: 149054
  derived and/or modified sequence opt3 from hemagglutinin__InfluenzaB__AGX23083

SEQ ID NO: 149655 - RNA, 1755 nt, Artificial Sequence; identical to SEQ ID NO: 148442
  derived and/or modified sequence opt3 from hemagglutinin__InfluenzaB__AGX23094

SEQ ID NO: 149656 - RNA, 1755 nt, Artificial Sequence; identical to SEQ ID NO: 148442
  derived and/or modified sequence opt3 from hemagglutinin__InfluenzaB__AGX23105

SEQ ID NO: 149657 - RNA, 1755 nt, Artificial Sequence; identical to SEQ ID NO: 149054
  derived and/or modified sequence opt3 from hemagglutinin__InfluenzaB__AGX23116

SEQ ID NO: 149658 - RNA, 1755 nt, Artificial Sequence; identical to SEQ ID NO: 148442
  derived and/or modified sequence opt3 from hemagglutinin__InfluenzaB__AGX23127

SEQ ID NO: 149659 - RNA, 1755 nt, Artificial Sequence; identical to SEQ ID NO: 148442
  derived and/or modified sequence opt3 from hemagglutinin__InfluenzaB__AGX23138

SEQ ID NO: 149660 - RNA, 1755 nt, Artificial Sequence
  derived and/or modified sequence opt3 from hemagglutinin__InfluenzaB__AGX23149
augaaggccaucauugugcugcucauggucguuaccagcaacgcugacagaauaugcacaggcaucacuuccucugauucaccccacgugguaaaaacggcaacccagggggaggugaaugucacaggagugauuccucuuacuaccacaccaaccaagaguuacuucgccaaccugaaagguacuaggacacggggcaaguuguguccggacugcuuaaauuguaccgaucuggacguugcgcuagggcgccccaugugcgugggaacgacuccuagcgcuaaagccuccauccuccaugaaguccgaccagugaccucuggcuguuuucccauuaugcacgaucguacaaagaucagacaacuggcaaaccuucugagggguuaugagaauauacgguugucgacucagaacguaaucgacgccgaaaaggcuccugggggaccauaccgccucggcaccucaggcagcugccccaaugcaacaaguaaauccggguucuuugccaccauggcuugggccguuccuaaggauaacaauaaaaacgcgacgaauccacugacuguggaggucccguauauuuguacagaaggagaggaccagaucaccgugugggguuuccauucugauaacaagacucagaugaaaaaucuguacggcgacagcaacccccaaaaguuuacauccucagcaaauggggugaccacgcacuaugucagucagauuggaggcuucccugaucagaccgaggacggugggcucccacagagcggaagaaucguuguggauuacaugaugcaaaagcccggcaaaacaggcacuauaguauaucagcgcgggguguuacugccucagaaggucuggugcgccucuggacgguccaaagugauuaaggguucacuuccauugaucggcgaagcugacugucugcaugagaaauacgggggacuaaacaagagcaaacccuacuauaccggcgaacacgccaaggcaauugguaacugcccgaucuggguuaagacaccucucaaacuggcuaaugggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaacaagaucaccaagaaucugaacuccuuaagcgaacuggaggugaaaaaucuccaaagacuuucgggugccauggaugaacugcauaacgagauuuuggagcuagacgaaaagguagaugaccugagggcugauacuaucucuucccagauagagcucgcgguucugcuuucaaaugaagggauuaucaacagugaggacgaacaccuguuggcacucgagcggaaacugaagaaaauguuaggcccuagcgccguggauaucggaaauggcuguuucgagacgaagcacaagugcaaccagacaugccuggaccguauugcugccgggaccuuuaaugcaggagaguucucccuacccacuuuugauucucucaacaucaccgccgcuagccugaaugacgauggucuugacaaccauacaauuuugcuguacuauucaaccgccgcaaguucccucgcggucacucugaugcuugcuauauucaucguguacauggucagccgcgacaaugugucuuguucaauuugccuguga

SEQ ID NO: 149661 - RNA, 1755 nt, Artificial Sequence
  derived and/or modified sequence opt3 from hemagglutinin__InfluenzaB__AGX23160
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaaucacgccuagcgcuaaagccuccauucuccaugaaguccgaccagugacuucuggcuguuuucccaucaugcacgaccguaccaagauaagacaacuggcaaaucuucugagggguuaugagaacauccgguugucgacacagaauguaauugaugccgaaaaggcuccugggggaccauaccgccucggcacuucaggcagcugccccaacgcaaccaguaaauccggguucuuugccacaauggcuugggccguuccuaaggacaauaacaaaaaugcgaccaacccacugacgguggaggucccguauaucuguacugaaggagaggaucagauuacagugugggguuuccauucugacaauaagacccagaugaaaaaccuguacggcgauagcaauccccaaagauuuacuuccucagcaaacggggugacaacccacuaugucagucagaucggaggcuucccugaccagacggaggauggugggcucccacagagcggaaggauaguuguggacuacaugaugcaaaagcccggcaagaccggcacaauuguauaucagcgcgggguguuacugccucagaaagucuggugcgccucuggacgguccaaggugaucaaagguucacuuccauugauuggcgaagcugauugucugcaugagaaguacgggggacuaaacaaaagcaagcccuacuauacuggcgaacacgccaaagcaaucgguaauugcccgaucuggguuaagaccccucuccgacuggcuaacgggacaaaguacagacccccagccaaacuucugaaggagaggggcuuuuucggagcgauugccggcuuuuuggaagggggaugggaagguaugauagcaggcuggcacggguauacaagucauggagcucacggcguggccgucgcugccgaccucaaaucuacccaggaggcaaucaauaagauuacuaaaaacuuaaauucccugagcgaacuggaggugaagaaccuccaacggcuuucgggugccauggacgaacugcauaaugagaucuuggagcuagaugaaaagguagacgaucugcgugcugacaccauaucuucccagauugagcucgcgguucugcuuucaaacgaagggaucaucaauagugaggaugaacaccuguuggcacucgagcgcaaacugaagaaaauguuaggcccuagcgccguggacauuggaaacggcuguuucgagacuaagcacaaaugcaaucagacgugccuggauagaaucgcugccgggacauuuaacgcaggagaguucucccuacccaccuuugacucucucaauauuacugccgcuagccugaacgaugacggucuugauaaucauaccauauugcuguacuauucaacagccgcaaguucccucgcggucacccugaugcuugcuaucuucauuguguacauggucagcagggacaacgugucuuguucaaucugccuguga

SEQ ID NO: 149662 - RNA, 1755 nt, Artificial Sequence
  derived and/or modified sequence opt3 from hemagglutinin__InfluenzaB__AGX23171
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaagauuuacauccucagcaaacggggugaccacgcacuaugucagucagauuggaggcuucccugaccagaccgaggauggugggcucccacagagcggaaggaucguuguggacuacaugaugcaaaagcccggcaagacaggcacuauaguauaucagcgcgggguguuacugccucagaaagucuggugcgccucuggacgguccaaggugauuaaagguucacuuccauugaucggcgaagcugauugucugcaugagaaguacgggggacuaaacaaaagcaagcccuacuauaccggcgaacacgccaaagcaauugguaauugcccgaucuggguuaagacaccucuccgacuggcuaacgggacuaaguacagacccccagccaaacuucugaaggagaggggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaaaaacuuaaauucccugagcgaacuggaggugaagaaccuccaacggcuuucgggugccauggacgaacugcauaaugagauuuuggagcuagaugaaaagguagacgaucugcgugcugacacuaucucuucccagauagagcucgcgguucugcuuucaaacgaagggauuaucaauagugaggaugaacaccuguuggcacucgagcgcaaacugaagaaaauguuaggcccuagcgccguggacaucggaaacggcuguuucgagacgaagcacaaaugcaaucagacaugccuggauagaauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagcagggacaacgugucuuguucaauuugccuguga

SEQ ID NO: 149663 - RNA, 1755 nt, Artificial Sequence; identical to SEQ ID NO: 148442
  derived and/or modified sequence opt3 from hemagglutinin__InfluenzaB__AGX23182

SEQ ID NO: 149664 - RNA, 1755 nt, Artificial Sequence; identical to SEQ ID NO: 148442
  derived and/or modified sequence opt3 from hemagglutinin__InfluenzaB__AGX23193

SEQ ID NO: 149665 - RNA, 1755 nt, Artificial Sequence; identical to SEQ ID NO: 149054
  derived and/or modified sequence opt3 from hemagglutinin__InfluenzaB__AGX23204

SEQ ID NO: 149666 - RNA, 1755 nt, Artificial Sequence; identical to SEQ ID NO: 148442
  derived and/or modified sequence opt3 from hemagglutinin__InfluenzaB__AGX23215

SEQ ID NO: 149667 - RNA, 1755 nt, Artificial Sequence
  derived and/or modified sequence opt3 from hemagglutinin__InfluenzaB__AGX23226
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcaaguggggugacaacccacuaugucagccagauuggaggcuucccugaccagacggaggauggugggcucccacagucuggaagaaucguuguggacuacaugauacaaaaacccggcaagaccggcacaauuguauaucagcgcgggguguuacugccucagaaagucuggugcgccuccggacggucaaaggugaucaaagguagccuuccauugauuggcgaagcugauugucugcaugagaaguacgggggacuaaacaaaaguaagcccuacuauacuggcgaacacgccaaggcaaucgguaacugcccgaucuggguuaaaaccccucucaagcuggcuaaugggacaaaauacaggcccccagccaaacuucugaaagagcgaggcuuuuucggagcgauugccggcuuuuuggaagggggaugggaagguaugauagcaggcuggcacggguauacuucucauggagcucacggcguggccgucgcugccgaccucaaguccacccaggaggcaaucaacaagauuacaaagaaucugaacagcuuaucggaacuggaggugaagaaucuccaaagacuuucuggugccauggacgaacugcauaacgagaucuuggagcuagaugaaaaaguagacgaucugagggcugacaccauauccucacagauugagcucgcgguucugcuuaguaaugaagggaucaucaacagcgaggaugaacaccuguuggcacucgagcggaagcugaaaaagauguuaggcccuuccgccguggacauuggaaauggcuguuucgagacuaagcacaaaugcaaccagacgugccuggaucguaucgcugccgggacauuuaaugcaggagaguucucucuacccaccuuugacagccucaacauuacugccgcuucacugaaugaugacggucuugauaaccauaccauauugcuguacuauaguacagccgcauccagccucgcggucacccugaugcuugcuaucuucauuguguacauggucucucgcgacaaugugucauguaguaucugccuguga

SEQ ID NO: 149668 - RNA, 1755 nt, Artificial Sequence; identical to SEQ ID NO: 149615
  derived and/or modified sequence opt3 from hemagglutinin__InfluenzaB__AGX23237

SEQ ID NO: 149669 - RNA, 1755 nt, Artificial Sequence
  derived and/or modified sequence opt3 from hemagglutinin__InfluenzaB__AGX23248
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguaaggaaggagaggaucagaucacagugugggguuuccauucugacaauaaaacccagaugaagaaccuguacggcgauagcaauccccaaaaguuuacuuccucagcaaguggggugacaacccacuaugucagccagauuggaggcuucccugaccagacggaggauggugggcucccacagucuggaagaaucguuguggacuacaugauacaaaaacccggcaagaccggcacaauuguauaucagcgcgggguguuacugccucagaaagucuggugcgccuccggacggucaaaggugaucaaagguagccuuccauugauuggcgaagcugauugucugcaugagaaguacgggggacuaaacaaaaguaagcccuacuauacuggcgaacacgccaaggcaaucgguaacugcccgaucuggguuaaaaccccucucaagcuggcuaaugggacaaaauacaggcccccagccaaacuucugaaagagcgaggcuuuuucggagcgauugccggcuuuuuggaagggggaugggaagguaugauagcaggcuggcacggguauacuucucauggagcucacggcguggccgucgcugccgaccucaaguccacccaggaggcaaucaacaagauuacaaagaaucugaacagcuuaucggaacuggaggugaagaaucuccaaagacuuucuggugccauggacgaacugcauaacgagaucuuggagcuagaugaaaaaguagacgaucugagggcugacaccauauccucacagauugagcucgcgguucugcuuaguaaugaagggaucaucaacagcgaggaugaacaccuguuggcacucgagcggaagcugaaaaagauguuaggcccuuccgccguggacauuggaaauggcuguuucgagacuaagcacaaaugcaaccagacgugccugaaucguaucgcugccgggacauuuaacgcaggagaguucucucuacccaccuuugauagccucaauauuacugccgcuucacugaacgacgauggucuugacaaucauaccauauugcuguacuauaguacagccgcauccagccucgcggucacccugaugcuugcuaucuucauuguguacauggucucucgcgauaacgugucauguaguaucugccuguga

SEQ ID NO: 149670 - RNA, 1755 nt, Artificial Sequence; identical to SEQ ID NO: 148442
  derived and/or modified sequence opt3 from hemagglutinin__InfluenzaB__AGX23259

SEQ ID NO: 149671 - RNA, 1755 nt, Artificial Sequence; identical to SEQ ID NO: 148442
  derived and/or modified sequence opt3 from hemagglutinin__InfluenzaB__AGX23270

SEQ ID NO: 149672 - RNA, 1755 nt, Artificial Sequence
  derived and/or modified sequence opt3 from hemagglutinin__InfluenzaB__AGX23281
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcagccaguaaauccggguucuuugcuacaauggccugggcgguuccuaaggacaauaacaaaaaugcaaccaacccacugacgguggaggucccguauauuuguacugaaggagaggaucagaucacagugugggguuuccauucugacaauaagacccagaugaaaaaccuguacggcgauagcaauccccaaaaguuuacuuccucagccaacggggugacaacccacuaugucagucagauuggaggcuucccugaccagacggaggauggugggcucccacagagcggaagaaucguuguggacuacaugaugcaaaagcccggcaaaaccggcacaauaguauaucagcgcgggguguuacugccucagaaggucuggugcgcuucuggacgguccaaagugauuaaggguucacuuccauugaucggcgaagccgauugucugcaugagaaauacgggggacuaaacaagagcaaacccuacuauacuggcgaacacgcaaaggcuauugguaauugcccgaucuggguuaagaccccucucaaacuggccaacgggacaaaguacaggcccccagcgaaacuucugaaggagcgaggcuuuuucggagccaucgcaggcuuuuuggaagggggaugggaagguaugauugcuggcuggcacggguauacuucccauggagcccacggcguggcugucgccgcagaccucaaaucuacccaggaggccauaaauaagaucacaaagaaccugaauaguuuaagcgaacuggaggugaaaaaccuccaaagacuuucgggugcuauggacgaacugcauucugagauuuuggagcuagaugaaaagguagacgaucugagggcggacaccaucuccucacagauagagcucgcaguucugcuuaguaaugaagggauuaucaacagcgaggaugaacaccuguuggcccucgagcggaaacugaagaaaauguuaggcccuuccgcuguggacaucggaaauggcuguuucgagacuaagcacaagugcaaccagacgugccuggaucguauugccgcagggacauuuaaugccggagaguucucucuacccaccuuugacagccucaacaucacugcugccucacugaaugaugacggucuugauaaccauaccauuuugcuguacuauaguacagcagcguccagccucgcugucacccugaugcuugccauauucaucguguacauggucucucgcgacaaugugucauguaguauuugccuguga

SEQ ID NO: 149673 - RNA, 1755 nt, Artificial Sequence
  derived and/or modified sequence opt3 from hemagglutinin__InfluenzaB__AGX23292
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaaauaguaaauccggguucuuugccacaauggcuugggccguuccuaaggacaacaauaaaaacgcgaccaauccacugacgguggaggucccguauauuuguacugaaggagaggaucagaucacagugugggguuuccauucugacaacaagacccagaugaaaaaucuguacggcgauagcaacccccaaaaguuuacuuccucagcaaacggggugacaacccacuaugucagucagauuggaggcuucccugaccagacggaggauggugggcucccacagagcggaagaaucguuguggacuacaugaugcaaaagcccggcaaaaccggcacaauaguauaucagcgcgggguguuacugccucagaaggucuggugcgccucuggacgguccaaagugauuaaggguucacuuccauugaucggcgaagcugauugucugcaugagaaauacgggggacuaaauaagagcaaacccuacuauacuggcgaacacgccaaggcaauugguaacugcccgaucuggguuaagaccccucucaaacuggcuaaugggacaaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacucaggaggcaauaaacaagaucacaaagaaucugaacuccuuaagcgaacuggaggugaaaaaucuccaaagacuuucgggugccauggacgaacugcauaacgagauuuuggagcuagaugaaaagguagacgaucugagggcugacaccaucucuucccagauagagcucgcgguucugcuuucaaaugaagggauuaucaacagugaggaugaacaccuguuggcacucgagcggaaacugaagaaaauguuaggcccuagcgccguggacaucggaaauggcuguuucgagacuaagcacaagugcaaccagacgugccuggaucguauugcugccgggacauuuaaugcaggagaguucucccuacccaccuuugacucucucaacaucacugccgcuagccugaaugaugacggucuugauaaccauaccauuuugcuguacuauucaacagccgcaaguucccucgcggucacccugaugcuugcuauauucaucguguacauggucagccgcgacaacgugucuuguucaauuugccuguga

SEQ ID NO: 149674 - RNA, 1755 nt, Artificial Sequence
  derived and/or modified sequence opt3 from hemagglutinin__InfluenzaB__AGX23314
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaacgcgcuccugggggaccauacagacucggcaccucaggcagcugccccaacgcaacaaguaaguccggguucuuugccaccauggcuugggccguuccuaaagacaauaacaagaaugcgacgaacccacugacuguggaggucccguauauuuguacagaaggagaggaucagaucaccgugugggguuuccauucugacaauaaaacucagaugaagaaccuguacggcgauagcaauccccaaaaauuuacauccucagcaaacggggugaccacgcacuaugucagucagauuggaggcuucccugaccagaccgaggauggugggcucccacagagcggaaggaucguuguggacuacaugaugcaaaagcccggcaagacaggcacuauaguauaucagcgcgggguguuacugccucagaaagucuggugcgccucuggacgguccaaggugauuaaagguucacuuccauugaucggcgaagcugauugucugcaugagaaguacgggggacuaaacaaaagcaagcccuacuauaccggcgaacacgccaaagcaauugguaauugcccgaucuggguuaagacaccucucaagcuggcuaacgggacuaaauaccgacccccagccaagcugcugaaagagagaggcuuuuucggagcgaucgccggcuuuuuggaagggggaugggaagguaugauugcaggcuggcacggguauaccagucauggagcucacggcguggccgucgcugccgaccucaagucuacacaggaggcaauaaauaaaaucaccaagaaccuuaauuccuuaagcgaacuggaggugaagaaccuccaaaggcuuucgggugccauggacgaacugcauaaugagauuuuggagcuagaugaaaaaguagacgaucugcgggcugacacuaucucuucccagauagagcucgcgguucugcuuucaaacgaagggauuaucaauagugaggaugaacaccuguuggcacucgagcguaagcugaaaaagauguuaggcccuagcgccguggacaucggaaacggcuguuucgagacgaaacacaagugcaaucagacaugccuggaucgcauugcugccgggaccuuuaacgcaggagaguucucccuacccacuuuugacucucucaauaucaccgccgcuagccugaacgaugacggucuugauaaucauacaauuuugcuguacuauucaaccgccgcaaguucccucgcggucacucugaugcuugcuauauucaucguguacauggucagcagagacaacgugucuuguucaauuugccuguga

SEQ ID NO: 149675 - RNA, 1755 nt, Artificial Sequence; identical to SEQ ID NO: 149674
  derived and/or modified sequence opt3 from hemagglutinin__InfluenzaB__AGX23325

SEQ ID NO: 149676 - RNA, 1755 nt, Artificial Sequence; identical to SEQ ID NO: 149674
  derived and/or modified sequence opt3 from hemagglutinin__InfluenzaB__AGX23336

SEQ ID NO: 149677 - RNA, 1755 nt, Artificial Sequence; identical to SEQ ID NO: 149674
  derived and/or modified sequence opt3 from hemagglutinin__InfluenzaB__AGX23347

SEQ ID NO: 149678 - RNA, 1755 nt, Artificial Sequence; identical to SEQ ID NO: 149674
  derived and/or modified sequence opt3 from hemagglutinin__InfluenzaB__AGX23358

SEQ ID NO: 149679 - RNA, 1755 nt, Artificial Sequence; identical to SEQ ID NO: 149674
  derived and/or modified sequence opt3 from hemagglutinin__InfluenzaB__AGX23369

SEQ ID NO: 149680 - RNA, 1755 nt, Artificial Sequence; identical to SEQ ID NO: 149674
  derived and/or modified sequence opt3 from hemagglutinin__InfluenzaB__AGX23380

SEQ ID NO: 149681 - RNA, 1755 nt, Artificial Sequence; identical to SEQ ID NO: 148442
  derived and/or modified sequence opt3 from hemagglutinin__InfluenzaB__AGX23391

SEQ ID NO: 149682 - RNA, 1755 nt, Artificial Sequence
  derived and/or modified sequence opt3 from hemagglutinin__InfluenzaB__AGX23413
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgaaucagaacguaaucgaugccgaacgcgcuccugggggaccauacagacucggcacuucaggcagcugccccaaugcaaccaguaaguccggguucuuugccacaauggcuugggccguuccuaaagacaacaauaagaacgcgaccaauccacugacgguggaggucccguauauuuguacugaaggagaggaucagaucacagugugggguuuccauucugacaacaaaacccagaugaagaaucuguacggcgauagcaacccccaaaaauuuacuuccucagcaaacggggugacaacccacuaugucagucagauuggaggcuucccugaccagacggaggauggugggcucccacagagcggaaggaucguuguggacuacaugaugcaaaagcccggcaagaccggcacaauaguauaucagcgcgggguguuacugccucagaaagucuggugcgccucuggacgguccaaggugauuaaagguucacuuccauugaucggcgaagcugauugucugcaugagaaguacgggggacuaaauaaaagcaagcccuacuauacuggcgaacacgccaaagcaauugguaacugcccgaucuggguuaagaccccucucaagcuggcuaaugggacaaaauaccgacccccagccaaacuucugaaggagagaggcuuuuucggagcgaucgccggcuuuuuggaagggggaugggaagguaugauugcaggcuggcacggguauaccagucauggagcucacggcguggccgucgcugccgaccucaagucuacucaggaggcaauaaacaaaaucacaaagaaucugaacuccuuaagcgaacuggaggugaagaaucuccaaaggcuuucgggugccauggacgaacugcauaacgagauuuuggagcuagaugaaaaaguagacgaucugcgggcugacaccaucucuucccagauagagcucgcgguucugcuuucaaaugaagggauuaucaacagugaggaugaacaccuguuggcacucgagcguaagcugaaaaagauguuaggcccuagcgccguggacaucggaaauggcuguuucgagacuaaacacaagugcaaccagacgugccuggaucgcauugcugccgggacauuuaaugcaggagaguucucccuacccaccuuugacucucucaacaucacugccgcuagccugaaugaugacggucuugauaaccauaccauuuugcuguacuauucaacagccgcaaguucccucgcggucacccugaugcuugcuauauucaucguguacauggucagcagagacaacgugucuuguucaauuugccuguga

SEQ ID NO: 149683 - RNA, 1755 nt, Artificial Sequence; identical to SEQ ID NO: 149682
  derived and/or modified sequence opt3 from hemagglutinin__InfluenzaB__AGX23424

SEQ ID NO: 149684 - RNA, 1755 nt, Artificial Sequence; identical to SEQ ID NO: 148836
  derived and/or modified sequence opt3 from hemagglutinin__InfluenzaB__AGX23435

SEQ ID NO: 149685 - RNA, 1755 nt, Artificial Sequence; identical to SEQ ID NO: 148747
  derived and/or modified sequence opt3 from hemagglutinin__InfluenzaB__AGX23446

SEQ ID NO: 149686 - RNA, 1755 nt, Artificial Sequence; identical to SEQ ID NO: 148836
  derived and/or modified sequence opt3 from hemagglutinin__InfluenzaB__AGX23457

SEQ ID NO: 149687 - RNA, 1755 nt, Artificial Sequence; identical to SEQ ID NO: 148747
  derived and/or modified sequence opt3 from hemagglutinin__InfluenzaB__AGX23468

SEQ ID NO: 149688 - RNA, 1755 nt, Artificial Sequence; identical to SEQ ID NO: 148442
  derived and/or modified sequence opt3 from hemagglutinin__InfluenzaB__AGX23479

SEQ ID NO: 149689 - RNA, 1755 nt, Artificial Sequence; identical to SEQ ID NO: 148442
  derived and/or modified sequence opt3 from hemagglutinin__InfluenzaB__AGX23490

SEQ ID NO: 149690 - RNA, 1755 nt, Artificial Sequence; identical to SEQ ID NO: 149063
  derived and/or modified sequence opt3 from hemagglutinin__InfluenzaB__AGX23501

SEQ ID NO: 149691 - RNA, 1755 nt, Artificial Sequence
  derived and/or modified sequence opt3 from hemagglutinin__InfluenzaB__AGX23512
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuuguacagaaggagaggaucagaucaccgugugggguuuccauucugacaauaaaacucagaugaagacacuguacggcgauagcaacccccaaaaguuuaccuccucagcaaauggggugacgacccacuaugucagucagauuggaggcuucccugaccagacagaggauggugggcucccacagagcggacgcaucguuguggacuacaugaugcaaaaacccggcaagacuggcaccauaguauaucagagagggguguuacugccucagaaagucuggugcgccucuggaagguccaaggugauuaaagguucacuuccauugaucggcgaagcugauugucugcaugagaaguacgggggacuaaacaaaagcaagcccuacuauacaggcgaacacgccaaggcaauugguaacugcccgaucuggguuaaaacuccucucaagcuggcuaaugggaccaaauaccggcccccagccaaacuucugaaggagcgcggcuuuuucggagcgaucgccggcuuuuuggaagggggaugggaagguaugauugcaggcuggcacggguauacaagucauggagcucacggcguggccgucgcugccgaccucaagucuacccaggaggcaauaaacaagaucacuaaaaaucugaacuccuuaagcgaacuggaggugaagaaucuccaacgacuuucgggugccauggacgaacugcauaacgagauuuuggagcuagaugaaaaaguagacgaucugagagcugacacgaucucuucccagauagagcucgcgguucugcuuucaaaugaagggauuaucaacagugaggaugaacaccuguuggcacucgagaggaagcugaaaaagauguuaggcccuagcgccguggacaucggaaauggcuguuucgagacaaagcacaaaugcaaccagaccugccuggaucggauugcugccgggacuuuuaaugcaggagaguucucccuacccaccuuugacucucucaacaucacagccgcuagccugaaugaugacggucuugauaaccauaccauuuugcuguacuauucaacugccgcaaguucccucgcggucacacugaugcuugcuauauucaucguguacauggucagccgugacaaugugucuuguucaauuugccuguga

SEQ ID NO: 149692 - RNA, 1755 nt, Artificial Sequence; identical to SEQ ID NO: 148442
  derived and/or modified sequence opt3 from hemagglutinin__InfluenzaB__AGX23523

SEQ ID NO: 149693 - RNA, 1755 nt, Artificial Sequence; identical to SEQ ID NO: 148747
  derived and/or modified sequence opt3 from hemagglutinin__InfluenzaB__AGX23534

SEQ ID NO: 149694 - RNA, 1755 nt, Artificial Sequence; identical to SEQ ID NO: 148747
  derived and/or modified sequence opt3 from hemagglutinin__InfluenzaB__AGX23545

SEQ ID NO: 149695 - RNA, 1755 nt, Artificial Sequence; identical to SEQ ID NO: 148442
  derived and/or modified sequence opt3 from hemagglutinin__InfluenzaB__AGX23556

SEQ ID NO: 149696 - RNA, 1755 nt, Artificial Sequence; identical to SEQ ID NO: 148442
  derived and/or modified sequence opt3 from hemagglutinin__InfluenzaB__AGX23567

SEQ ID NO: 149697 - RNA, 1755 nt, Artificial Sequence; identical to SEQ ID NO: 148442
  derived and/or modified sequence opt3 from hemagglutinin__InfluenzaB__AGX23578

SEQ ID NO: 149698 - RNA, 1755 nt, Artificial Sequence; identical to SEQ ID NO: 148442
  derived and/or modified sequence opt3 from hemagglutinin__InfluenzaB__AGX23600

SEQ ID NO: 149699 - RNA, 1755 nt, Artificial Sequence
  derived and/or modified sequence opt3 from hemagglutinin__InfluenzaB__AGX23611
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagcgcgggguguuacugccucagaaggucuggugcgccucuggacgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucucaaacuggcuaacgggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaagaacuuaaauucccugagcgaacuggagauuaaaaaccuccaaagacuuucgggugccauggacgaacugcauaaugagaucuuggagcuagaugaaaagguggacgaucugagggcugacacuauaucuucccagauugagcucgcgguacugcuuucaaacgaagggaucaucaauagugaggaugaacaccuguuggcacucgagcggaaacugaagaaaauguuaggcccuagcgccguugacauuggaaacggcuguuucgagacgaagcacaagugcaaucagacaugccuggaucguaucgcugccgggaccuuuaacgcaggagaguucucccuacccacuuuugacucucucaauauuaccgccgcuagccugaacgaugacggucuugauaaucauacaauauugcuguacuauucaaccgccgcaaguucccucgcggugacucugaugcuugcuaucuucauugucuacauggugagccgcgacaacgucucuuguucaaucugccuguga

SEQ ID NO: 149700 - RNA, 1755 nt, Artificial Sequence; identical to SEQ ID NO: 148442
  derived and/or modified sequence opt3 from hemagglutinin__InfluenzaB__AGX23622

SEQ ID NO: 149701 - RNA, 1755 nt, Artificial Sequence; identical to SEQ ID NO: 148747
  derived and/or modified sequence opt3 from hemagglutinin__InfluenzaB__AGX23633

SEQ ID NO: 149702 - RNA, 1755 nt, Artificial Sequence; identical to SEQ ID NO: 148747
  derived and/or modified sequence opt3 from hemagglutinin__InfluenzaB__AGX23644

SEQ ID NO: 149703 - RNA, 1755 nt, Artificial Sequence; identical to SEQ ID NO: 148442
  derived and/or modified sequence opt3 from hemagglutinin__InfluenzaB__AGX23655

SEQ ID NO: 149704 - RNA, 1755 nt, Artificial Sequence; identical to SEQ ID NO: 148747
  derived and/or modified sequence opt3 from hemagglutinin__InfluenzaB__AGX23666

SEQ ID NO: 149705 - RNA, 1755 nt, Artificial Sequence
  derived and/or modified sequence opt3 from hemagglutinin__InfluenzaB__AGX23677
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaaaauaagguugucgacucagaacguaaucgaugccgaaaaggcuccugggggaccauaccggcucggcaccucaggcagcugccccaaugcaacaaguaaauccggguucuuugccaccauggcuugggccguuccuaaggacaacaauaaaaacgcgacgaauccacugacuguggaggucccguauauuuguaucgaaggagaggaucagauuacagugugggguuuccauucugacaacaagacccagaugaagaaucuguacggcgauagcaacccccaaaaauuuacuuccucagcaaauggggugacaacccacuaugucagucagaucggaggcuucccugaccagacggaggauggugggcucccacagagcggacgcauaguuguggacuacaugaugcaaaagcccggcaaaaccggcacaauuguauaucagagagggguguuacugccucagaaggucuggugcgccucuggaagguccaaagugaucaaggguucacuuccauugauuggcgaagcugauugucugcaugagaaauacgggggacuaaacaagagcaagcccuacuauacuggcgaacacgccaaagcaaucgguaacugcccgaucuggguuaagaccccucucaaacuggcuaaugggacaaaguaccggcccccagccaaacuucugaaggagcgcggcuuuuucggagcgauugccggcuuuuuggaagggggaugggaagguaugauagcaggcuggcacggguauaccagucauggagcucacggcguggccgucgcugccgaccucaagucuacucaggaggcaaucaacaaaauuacaaagaaucugaacuccuuaagcgaacuggaggugaaaaaucuccaacgacuuucgggugccauggacgaacugcauaacgagaucuuggagcuagaugaaaagguagacgaucugagagcugacaccauaucuucccagauugagcucgcgguucugcuuucaaaugaagggaucaucaacagugaggaugaacaccuguuggcacucgagaggaaacugaagaagauguuaggcccuagcgccguggacauuggaaauggcuguuucgagacuaaacacaagugcaaccagacgugccuggaucggaucgcugccgggacauuuaaugcaggagaguucucccuacccaccuuugacucucucaacauuacugccgcuagccugaaugaugacggucuugauaaccauaccauauugcuguacuauucaacagccgcaaguucccucgcggucacccugaugcuugcuaucuucauuguguacauggucagccgugacaaugugucuuguucaaucugccuguga

SEQ ID NO: 149706 - RNA, 1755 nt, Artificial Sequence; identical to SEQ ID NO: 148747
  derived and/or modified sequence opt3 from hemagglutinin__InfluenzaB__AGX23688

SEQ ID NO: 149707 - RNA, 1755 nt, Artificial Sequence; identical to SEQ ID NO: 148747
  derived and/or modified sequence opt3 from hemagglutinin__InfluenzaB__AGX23699

SEQ ID NO: 149708 - RNA, 1755 nt, Artificial Sequence; identical to SEQ ID NO: 148442
  derived and/or modified sequence opt3 from hemagglutinin__InfluenzaB__AGX23710

SEQ ID NO: 149709 - RNA, 1755 nt, Artificial Sequence; identical to SEQ ID NO: 148747
  derived and/or modified sequence opt3 from hemagglutinin__InfluenzaB__AGX23721

SEQ ID NO: 149710 - RNA, 1755 nt, Artificial Sequence; identical to SEQ ID NO: 148442
  derived and/or modified sequence opt3 from hemagglutinin__InfluenzaB__AGX23732

SEQ ID NO: 149711 - RNA, 1755 nt, Artificial Sequence; identical to SEQ ID NO: 148747
  derived and/or modified sequence opt3 from hemagglutinin__InfluenzaB__AGX23743

SEQ ID NO: 149712 - RNA, 1755 nt, Artificial Sequence; identical to SEQ ID NO: 148747
  derived and/or modified sequence opt3 from hemagglutinin__InfluenzaB__AGX23754

SEQ ID NO: 149713 - RNA, 1755 nt, Artificial Sequence; identical to SEQ ID NO: 148442
  derived and/or modified sequence opt3 from hemagglutinin__InfluenzaB__AGX23765

SEQ ID NO: 149714 - RNA, 1755 nt, Artificial Sequence; identical to SEQ ID NO: 148747
  derived and/or modified sequence opt3 from hemagglutinin__InfluenzaB__AGX23776

SEQ ID NO: 149715 - RNA, 1755 nt, Artificial Sequence; identical to SEQ ID NO: 148747
  derived and/or modified sequence opt3 from hemagglutinin__InfluenzaB__AGX23787

SEQ ID NO: 149716 - RNA, 1755 nt, Artificial Sequence; identical to SEQ ID NO: 148442
  derived and/or modified sequence opt3 from hemagglutinin__InfluenzaB__AGX23798

SEQ ID NO: 149717 - RNA, 1755 nt, Artificial Sequence; identical to SEQ ID NO: 148442
  derived and/or modified sequence opt3 from hemagglutinin__InfluenzaB__AGX23809

SEQ ID NO: 149718 - RNA, 1755 nt, Artificial Sequence; identical to SEQ ID NO: 148442
  derived and/or modified sequence opt3 from hemagglutinin__InfluenzaB__AGX23820

SEQ ID NO: 149719 - RNA, 1755 nt, Artificial Sequence; identical to SEQ ID NO: 148747
  derived and/or modified sequence opt3 from hemagglutinin__InfluenzaB__AGX23831

SEQ ID NO: 149720 - RNA, 1755 nt, Artificial Sequence; identical to SEQ ID NO: 148442
  derived and/or modified sequence opt3 from hemagglutinin__InfluenzaB__AGX23842

SEQ ID NO: 149721 - RNA, 1755 nt, Artificial Sequence
  derived and/or modified sequence opt3 from hemagglutinin__InfluenzaB__AGX23853
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgauccagaauguaauugaugccgaaaaggcuccugggggaccauaccgccucggcacuucaggcagcugccccaacgcaaccaguaaauccggguucuuugccacaauggcuugggccguuccuaaggacaauaacaaaaaugcgaccaacccacugacgguggaggucccguauaucuguacugaaggagaggaucagauuacagugugggguuuccauucugacaauaagacccagaugaaaaaccuguacggcgauagcaauccccaaaaguuuacuuccucagcaaacggggugacaacccacuaugucagucagaucggaggcuucccugaccagacggaggauggugggcucccacagagcggaagaauaguuguggacuacaugaugcaaaagucuggcaaaaccggcacaauuguauaucagaggggaguguuacugccccagaaggucuggugcgccuccgggcggucaaaagugaucaaggguagccuuccuuugauuggcgaagcugauugucugcaugagaaauacgggggacuaaacaagaguaaaccauacuauacuggcgaacacgccaaggcaaucgguaauugccccaucuggguuaagaccccgcucaaacuggcuaacgggacaaaguaccgcccucccgccaaacuucugaaggagcgaggcuuuuucggagcgauugccggcuuuuuggaagggggaugggaagguaugauagcaggcuggcacggguauacuucucauggagcucacggcguggccgucgcugccgaccucaaauccacccaggaggcaaucaauaagauuacaaagaaccugaauagcuuaucggaacuggaggugaaaaaccuccaaagacuuucuggugccauggacgaacugcauaaugagaucuuggagcuagaugaaaagguagacgaucugagggcugacaccauauccucacagauugagcucgcgguucugcuuaguaacgaagggaucaucaauagcgaggaugaacaccuguuggcacucgagcggaaacugaagaaaauguuaggcccauccgccguggacauuggaaacggcuguuucgagacuaagcacaagugcaaucagacgugccuggaucguaucgcugccgggacauuuaacgcaggagaguucucucuaccuaccuuugacagccucaauauuacugccgcuucacugaacgaugacggucuugauaaucauaccauauugcuguacuauaguacagccgcauccagccucgcggucacccugaugcuugcuaucuucauuguguacauggucucucgcgacaacgugucauguaguaucugccuguga

SEQ ID NO: 149722 - RNA, 1755 nt, Artificial Sequence; identical to SEQ ID NO: 148442
  derived and/or modified sequence opt3 from hemagglutinin__InfluenzaB__AGX23864

SEQ ID NO: 149723 - RNA, 1755 nt, Artificial Sequence; identical to SEQ ID NO: 148747
  derived and/or modified sequence opt3 from hemagglutinin__InfluenzaB__AGX23875

SEQ ID NO: 149724 - RNA, 1755 nt, Artificial Sequence; identical to SEQ ID NO: 148442
  derived and/or modified sequence opt3 from hemagglutinin__InfluenzaB__AGX23886

SEQ ID NO: 149725 - RNA, 1755 nt, Artificial Sequence
  derived and/or modified sequence opt3 from hemagglutinin__InfluenzaB__AGX23897
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagucuggcaaaacaggcacuauaguauaucagaggggaguguuacugccccagaaggucuggugcgccuccgggcggucaaaagugauuaaggguagccuuccuuugaucggcgaagcugauugucugcaugagaaauacgggggacuaaacaagaguaaaccauacuauaccggcgaacacgccaaggcaauugguaauugccccaucuggguuaagacaccgcucaaacuggcuaacgggacuaaguaccgcccucccgccaaacuucugaaggagcgaggcuuuuucggagcgaucgccggcuuuuuggaagggggaugggaagguaugauugcaggcuggcacggguauaccucucauggagcucacggcguggccgucgcugccgaccucaaauccacacaggaggcaauaaauaagaucaccaagaaccugaauagcuuaucggaacuggaggugaaaaaccuccaaagacuuucuggugccauggacgaacugcauaaugagauuuuggagcuagaugaaaagguagacgaucugagggcugacacuaucuccucacagauagagcucgcgguucugcuuaguaacgaagggauuaucaauagcgaggaugaacaccuguuggcacucgagcggaaacugaagaaaauguuaggcccauccgccguggacaucggaaacggcuguuucgagacgaagcacaagugcaaucagacaugccuggaucguauugcugccgggaccuuuaacgcaggagaguucucucuaccuacuuuugacagccucaauaucaccgccgcuucacugaacgaugacggucuugauaaucauacaauuuugcuguacuauaguaccgccgcauccagccucgcggucacucugaugcuugcuauauucaucguguacauggucucucgcgacaacgugucauguaguauuugccuguga

SEQ ID NO: 149726 - RNA, 1755 nt, Artificial Sequence
  derived and/or modified sequence opt3 from hemagglutinin__InfluenzaB__AGX23908
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuuguuaccauggccugggcugugccuaaggacaauaacaaaaaugccacgaacccacugacugucgaggugccguauauuuguacagaaggagaggaucagaucaccgugugggguuuccauucugacaauaagacucagaugaaaaaccuguacggcgauagcaauccccaaaaguuuacauccucagcgaacggggucaccacgcacuauguuagucagauuggaggcuucccugaccagaccgaggauggugggcucccacagagcggaagaaucgugguagacuacaugaugcaaaagcccggcaaaacaggcacuauaguguaucagcgcggggucuuacugccucagaagguguggugcgcaucuggacgguccaaaguuauuaaggguucacuuccauugaucggcgaagccgauugucugcaugagaaauacgggggacuaaacaagagcaaacccuacuauaccggcgaacacgcuaaggccauugguaauugcccgaucugggugaagacaccucucaaacuggcaaacgggacuaaguacaggcccccagcuaaacuucugaaggagcgaggcuuuuucggagccaucgcgggcuuuuuggaagggggaugggaagguaugauugccggcuggcacggguauaccagucauggagcacacggcgucgcuguggccgcugaccucaaaucuacacaggaggccauaaauaagaucaccaagaacuuaaauucccugagcgaacuggagguuaaaaaccuccaaagacuuucgggugcaauggacgaacugcauaaugagauuuuggagcuagaugaaaagguagacgaucugagggccgacacuaucucuucccagauagagcucgcugugcugcuuucaaacgaagggauuaucaauagugaggaugaacaccuguuggcgcucgagcggaaacugaagaaaauguuaggcccuagcgcagucgacaucggaaacggcuguuucgagacgaagcacaagugcaaucagacaugccuggaucguauugccgcugggaccuuuaacgccggagaguucucccuacccacuuuugacucucucaauaucaccgcagccagccugaacgaugacggucuugauaaucauacaauuuugcuguacuauucaaccgcugccaguucccucgcagugacucugaugcuugcgauauucaucgucuacauggugagccgcgacaacguuucuuguucaauuugccuguga

SEQ ID NO: 149727 - RNA, 1755 nt, Artificial Sequence; identical to SEQ ID NO: 148583
  derived and/or modified sequence opt3 from hemagglutinin__InfluenzaB__AGX23919

SEQ ID NO: 149728 - RNA, 1755 nt, Artificial Sequence; identical to SEQ ID NO: 149063
  derived and/or modified sequence opt3 from hemagglutinin__InfluenzaB__AGX23930

SEQ ID NO: 149729 - RNA, 1755 nt, Artificial Sequence; identical to SEQ ID NO: 148442
  derived and/or modified sequence opt3 from hemagglutinin__InfluenzaB__AGX23941

SEQ ID NO: 149730 - RNA, 1755 nt, Artificial Sequence; identical to SEQ ID NO: 148747
  derived and/or modified sequence opt3 from hemagglutinin__InfluenzaB__AGX23952

SEQ ID NO: 149731 - RNA, 1755 nt, Artificial Sequence; identical to SEQ ID NO: 148747
  derived and/or modified sequence opt3 from hemagglutinin__InfluenzaB__AGX23963

SEQ ID NO: 149732 - RNA, 1755 nt, Artificial Sequence; identical to SEQ ID NO: 149063
  derived and/or modified sequence opt3 from hemagglutinin__InfluenzaB__AGX23974

SEQ ID NO: 149733 - RNA, 1755 nt, Artificial Sequence; identical to SEQ ID NO: 148583
  derived and/or modified sequence opt3 from hemagglutinin__InfluenzaB__AGX23985

SEQ ID NO: 149734 - RNA, 1755 nt, Artificial Sequence
  derived and/or modified sequence opt3 from hemagglutinin__InfluenzaB__AGX23996
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccaauuaccucuggcuguuuucccaucaugcacgaccguacaaagauaagacaacuggcaaaucuucugagggguuaugagaacauccgguugucgacucagaaugugauugaugccgaaaaggcuccugggggaccauaccgccucggcaccucaggcagcugccccaacgcaacaaguaaauccggguucuuugccaccauggcuugggccguaccuaaggacaauaacaaaaaugcgacgaacccacugacuguugaggugccguauaucuguacagaaggagaggaucagauuaccgucugggguuuccauucugacaauaagacucagaugaaaaaccuguacggcgauagcaauccccaaaaguuuacauccucagcaaacggggugaccacgcacuaugugagucagaucggaggcuucccugaccagaccgaggauggugggcucccacagagcggaagaauagucguugacuacaugaugcaaaagcccggcaaaacaggcacuauuguguaucagcgcgggguauuacugccucagaagguguggugcgccucuggacgguccaaagucaucaaggguucacuuccauugauuggcgaagcugauugucugcaugagaaauacgggggacuaaacaagagcaaacccuacuauaccggcgaacacgccaaggcaaucgguaauugcccgaucugggugaagacaccucucaaacuggcuaacgggacuaaguacaggcccccagccaaacuucugaaggagcgaggcuuuuucggagcgauugccggcuuuuuggaagggggaugggaagguaugauagcaggcuggcacggguauaccagucauggagcucacggcguugccguggcugccgaccucaaaucuacacaggaggcaaucaauaagauuaccaagaacuuaaauucccugagcgaacuggaggucaaaaaccuccaaagacuuucgggugccauggacgaacugcauaaugagaucuuggagcuagaugaaaagguggacgaucugagggcugacacuauaucuucccagauugagcucgcgguacugcuuucaaacgaagggaucaucaauagugaggaugaacaccuguuggcacucgagcggaaacugaagaaaauguuaggcccuagcgccguugacauuggaaacggcuguuucgagacgaagcacaagugcaaucagacaugccuggaucguaucgcugccgggaccuuuaacgcaggagaguucucccuacccacuuuugacucucucaauauuaccgccgcuagccugaacgaugacggucuugauaaucauacaauauugcuguacuauucaaccgccgcaaguucccucgcggugacucugaugcuugcuaucuucauugucuacauggugagccgcgacaacgucucuuguucaaucugccuguga

SEQ ID NO: 149735 - RNA, 1755 nt, Artificial Sequence; identical to SEQ ID NO: 149063
  derived and/or modified sequence opt3 from hemagglutinin__InfluenzaB__AGX24007

SEQ ID NO: 149736 - RNA, 1755 nt, Artificial Sequence; identical to SEQ ID NO: 149063
  derived and/or modified sequence opt3 from hemagglutinin__InfluenzaB__AGX24018

SEQ ID NO: 149737 - RNA, 1755 nt, Artificial Sequence
  derived and/or modified sequence opt3 from hemagglutinin__InfluenzaB__AGX24029
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguaaggaaggagaggaucagaucacagugugggguuuccauucugacaauaaaacccagaugaagaaccuguacggcgauagcaauccucaaaaguuuacuuccucagcgaacggggugacaacccacuaugucagucagauuggcagcuucccagaccagacggaggauggaggucucccccagucugggagaaucguuguggacuacaugaugcaaaaaccuggaaagaccggcacaauaguauaucagaggggcguguuacugccacagaaagucuggugcgcauccgggcggucaaaggugauuaaaggaagccuucccuugaucggugaagccgauugucugcaugagaaguacggcgggcuaaacaaaaguaagccguacuauacuggagaacacgcuaaggccauuggcaauugcccuaucuggguuaaaaccccucucaagcuggcaaacgguacaaaauaccgcccacccgcuaaacuucugaaagagcgaggguuuuucggcgccaucgcgggauuuuuggagggcgggugggaaggaaugauugccgguuggcacggcuauacuucucauggggcacacggaguggcugucgccgcugaccucaaguccacccaggaggccauaaauaagaucacaaagaaccugaauagcuuaucggaacuggaggugaagaaccuccaaagacuuucuggcgcaauggacgaacugcauaaugagauuuuggagcuagaugaaaaaguagacgaucugagggccgacaccaucuccucacagauagagcucgcuguucugcuuaguaacgaagguauuaucaauagcgaggaugaacaccuguuggcgcucgagcggaagcugaaaaagauguuagggcccuccgcaguggagaucggcaacggauguuucgaaacuaagcacaaaugcaaucagacgugccugaaccguauugccgcuggcacauuuaaugccggggaguucucucuaccaaccuuugacagccucaacaucacugcagccucacugaaugaugacggacuugauaaccauaccauuuugcuguacuauaguacagcugccuccagccucgcagucacccugaugcuugcgauauucaucguguacauggucucucgcgacaacgugucauguaguauuugccuguga

SEQ ID NO: 149738 - RNA, 1755 nt, Artificial Sequence; identical to SEQ ID NO: 149063
  derived and/or modified sequence opt3 from hemagglutinin__InfluenzaB__AGX24040

SEQ ID NO: 149739 - RNA, 1755 nt, Artificial Sequence; identical to SEQ ID NO: 148747
  derived and/or modified sequence opt3 from hemagglutinin__InfluenzaB__AGX24051

SEQ ID NO: 149740 - RNA, 1755 nt, Artificial Sequence; identical to SEQ ID NO: 148836
  derived and/or modified sequence opt3 from hemagglutinin__InfluenzaB__AGX24062

SEQ ID NO: 149741 - RNA, 1755 nt, Artificial Sequence; identical to SEQ ID NO: 148583
  derived and/or modified sequence opt3 from hemagglutinin__InfluenzaB__AGX24073

SEQ ID NO: 149742 - RNA, 1755 nt, Artificial Sequence
  derived and/or modified sequence opt3 from hemagglutinin__InfluenzaB__AGX24084
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccaucauucaugaaguccgaccagugaccucuggcuguuuucccaucaugcacgaccguacaaagauaagacaacucgcaaaucugcuuagggguuaugagaacauccggcugucgacucagaauguaauugaugccgaaaaggcuccugggggaccauaccgcuugggcaccucaggcagcugccccaacgcaacaaguaaauccggguucuuugccaccauggcuugggccguuccuaaggacaauaacaaaaaugcgacgaacccacucacuguggaggucccguauaucuguacagaaggagaggaucagauuaccgugugggguuuccauucugacaauaagacucagaugaaaaaccuguacggcgauagcaauccccaaaaguuuacauccucagcaaacggggugaccacgcacuaugucagucagaucggaggcuucccugaccagaccgaggauggugggcugccacagagcggaagaauaguuguggacuacaugaugcaaaagcccggcaaaacaggcacuauuguauaucagcgcggggugcucuuaccucagaaggucuggugcgccucuggacgguccaaagugaucaaggguucacugccacuuauuggcgaagcugauuguuugcaugagaaauacgggggacugaacaagagcaaacccuacuauaccggcgaacacgccaaggcaaucgguaauugcccgaucuggguuaagacaccucuaaaacucgcuaacgggacuaaguacaggcccccagccaaacugcuuaaggagcgaggcuuuuucggagcgauugccggcuuucuggaagggggaugggaagguaugauagcaggcuggcacggguauaccagucauggagcucacggcguggccgucgcugccgacuugaaaucuacacaggaggcaaucaauaagauuaccaagaaccucaauucccugagcgaauuagaggugaaaaaccugcaaagacucucgggugccauggacgaacuucauaaugagauccuggaguuggaugaaaagguagacgaucuaagggcugacacuauaucuucccagauugagcuggcgguucuccugucaaacgaagggaucaucaauagugaggaugaacaccuucuggcauuggagcggaaacucaagaaaaugcugggcccuagcgccguggacauuggaaacggcuguuucgagacgaagcacaagugcaaucagacaugcuuagaucguaucgcugccgggaccuuuaacgcaggagaguucucccugcccacuuuugacucucuaaauauuaccgccgcuagccucaacgaugacggucuggauaaucauacaauacuuuuguacuauucaaccgccgcaaguucccuggcggucacucucaugcuggcuaucuucauuguguacauggucagccgcgacaacgugucuuguucaaucugccuuuga

SEQ ID NO: 149743 - RNA, 1755 nt, Artificial Sequence; identical to SEQ ID NO: 149063
  derived and/or modified sequence opt3 from hemagglutinin__InfluenzaB__AGX24095

SEQ ID NO: 149744 - RNA, 1755 nt, Artificial Sequence
  derived and/or modified sequence opt3 from hemagglutinin__InfluenzaB__AGX24106
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacacaaccaguaaauccggguucuuugcaacgauggccugggcuguuccuaaggacaauaacaaaaaugccacuaacccacugacaguggaggucccguauauuuguaccgaaggagaggaucagaucacugugugggguuuccauucugacaauaagacacagaugaaaaaccuguacggcgauagcaauccccaaaaguuuaccuccucagcgaacggggugacgacccacuaugucagucagauuggaggcuucccugaccagacagaggauggugggcucccacagagcggaagaaucguuguggacuacaugaugcaaaagcccggcaaaacuggcaccauaguauaucagcgcgggguguuacugccucagaaggucuggugcgcaucuggacgguccaaagugauuaaggguucacuuccauugaucggcgaagccgauugucugcaugagaaauacgggggacuaaacaagagcaaacccuacuauacaggcgaacacgcuaaggccauugguaauugcccgaucuggguuaagacuccucucaaacuggcaaacgggaccaaguacaggcccccagcuaaacuucugaaggagcgaggcuuuuucggagccaucgcgggcuuuuuggaagggggaugggaagguaugauugccggcuggcacggguauacaagucauggagcacacggcguggcugucgccgcugaccucaaaucuacccaggaggccauaaauaagaucacuaagaacuuaaauucccugagcgaacuggaggugaaaaaccuccaaagacuuucgggugcaauggacgaacugcauaaugagauuuuggagcuagaugaaaagguagacgaucugagggccgacacgaucucuucccagauagagcucgcuguucugcuuucaaacgaagggauuaucaauagugaggaugaacaccuguuggcgcucgagcggaaacugaagaaaauguuaggcccuagcgcaguggacaucggaaacggcuguuucgagacaaagcacaagugcaaucagaccugccuggaucguauugccgcugggacuuuuaacgccggagaguucucccuacccaccuuugacucucucaauaucacagcagccagccugaacgaugacggucuugauaaucauaccauuuugcuguacuauucaacugcugccaguucccucgcagucacacugaugcuugcgauauucaucguguacauggucagccgcgacaacgugucuuguucaauuugccuguga

SEQ ID NO: 149745 - RNA, 1755 nt, Artificial Sequence
  derived and/or modified sequence opt3 from hemagglutinin__InfluenzaB__AGX24117
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacacaaccaguaaauccggguucuuugcuacgauggcaugggccguuccaaaggacaauaacaaaaaugcuacuaacccgcugacaguggagguccccuauauuuguaccgaaggagaggaucagaucacugugugggguuuccauucugacaauaagacacagaugaaaaaccuguacggcgauagcaauccucaaaaguuuaccuccucagccaacggggugacgacccacuaugucagucagauuggcagcuucccagaccagacagaggauggaggucucccccagucugggagaaucguuguggacuacaugaugcaaaagccuggaaaaacuggcaccauaguauaucagaggggcauuuuacugccacagaagguguggugcgcguccgggcggucaaaagucaucaagggaagccuucccuugauuggugaagcagauugucugcaugagaaauacggcgggcuaaacaagaguaaaccguacuauacaggagaacacgccaaggcuaucggcaauugcccuaucugggugaagacuccccucaaacuggccaacgguaccaaguaccgcccuccagcaaaacuucugaaggagcgaggguuuuucggcgcuauugccggauuuuuggagggcgggugggaaggaaugauagcggguuggcacggcuauacaucucauggggcccacggaguugcaguggcugccgaccucaaauccacccaggaggcuaucaauaagauuacuaagaaccugaauagcuuaucggaacuggaggucaaaaaccuccaaagacuuucuggcgccauggacgaacugcauaaugagaucuuggagcuagaugaaaagguggacgaucugagggcagacacgauauccucacagauugagcucgccguacugcuuaguaacgaagguaucaucaauagcgaggaugaacaccuguuggcucucgagcggaaacugaagaaaauguuagggcccuccgcgguugagauuggcaacggauguuucgaaacaaagcacaagugcaaucagaccugccuggaccguaucgcagccggcacuuuuaacgcuggggaguucucucuaccaaccuuugauagccucaauauuacagccgcaucacugaacgacgauggacuugacaaucauaccauauugcuguacuauaguacugccgcuuccagccucgccgugacacugaugcuugcaaucuucauugucuacauggugucucgcgauaacgucucauguaguaucugccuguga

SEQ ID NO: 149746 - RNA, 1755 nt, Artificial Sequence
  derived and/or modified sequence opt3 from hemagglutinin__InfluenzaB__AGX24128
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacuguauccaugagaaauacggcgggcugaacaagucaaaaccguauuacaccggagaacacgcuaaggccaucggcaacugcccuauuuggguuaagacaccccuaaaacucgcaaaugguacuaaguaucgcccuccagcuaaacugcuuaaggagcgaggguuuuucggcgccauagcgggauuucuggagggcgggugggaaggaaugaucgccgguuggcacggcuacaccagccauggggcacacggaguggcugucgccgcugacuugaaaaguacacaggaggccauuaacaagaucaccaagaaucucaacucucuguccgaauuagaggugaaaaaucugcaaagacucagcggcgcaauggaugaacuucauaacgagauacuggaguuggacgaaaagguagaugaccuaagggccgauacuauuucgucucagaucgagcuggcuguucuccuguccaaugaagguaucauuaacucagaggacgaacaccuucuggcguuggagcggaaacucaagaaaaugcuggggcccagugcaguggauaucggcaauggauguuucgagacgaagcacaagugcaaccagacaugcuuagaccguauugccgcuggcaccuuuaaugccggggaguucagccugccaacuuuugauucccuaaacauaaccgcagccucucucaaugacgauggacuggacaaccauacaauccuuuuguauuacagcaccgcugccucaagucuggcagucacucucaugcuggcgauuuucaucguguauauggucucccgcgacaaugugagcuguucuaucugccuuuga

SEQ ID NO: 149747 - RNA, 1755 nt, Artificial Sequence; identical to SEQ ID NO: 148442
  derived and/or modified sequence opt3 from hemagglutinin__InfluenzaB__AGX24139

SEQ ID NO: 149748 - RNA, 1755 nt, Artificial Sequence
  derived and/or modified sequence opt3 from hemagglutinin__InfluenzaB__AGX24150
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccguauugcuuaaacuguaccgaucuggacguugcgcuagggcgccccaugugcgugggaacgacuccuagcgcuaaagccuccauccuccaugaaguccgaccagugaccucuggcuguuuucccauuaugcacgaucguacaaagaucagacaacugccuaaucuucugagggguuacgagaacauacgguugucgacucagaauguaaucgacgcagaaaaggccccagggggacccuaucgccucggcaccucaggcagcugcccuaacgcuacaaguaaauccggguucuuugcaaccauggccugggcuguuccaaaggauaauaacaaaaaugccacgaacccgcugacuguggagguccccuacauuuguacagaaggagaggaccagaucaccgugugggguuuccauucugauaauaagacucagaugaaaaaccuguauggcgacagcaauccucaaaaguuuacauccucagcgaacggggugaccacgcacuacgucagucagauuggcagcuucccagaucagaccgaggacggaggucucccccagucugggagaaucguuguggauuauaugaugcaaaagccuggaaaaacaggcacuauaguauaccagaggggcauuuuacugccacagaagguguggugcgcauccgggcggucaaaagucaucaagggaagccuucccuugauuggugaagccgacugucugcaugagaaauacggcgggcuaaacaagaguaaaccguauuacaccggagaacacgcuaaggccaucggcaauugcccuaucugggugaagacaccccucaaacuggcaaacgguacuaaguaucgcccuccagcuaaacuucugaaggagcgaggguuuuucggcgccauugcgggauuuuuggagggcgggugggaaggaaugauagccgguuggcacggcuacaccucucauggggcacacggaguugcuguggccgcugaucucaaauccacacaggaggccaucaauaagauuaccaagaaccugaauagcuuaucggaacuggaggucaaaaaccuccaaagacuuucuggcgcaauggacgaacugcauaaugagaucuuggagcuagacgaaaagguggaugaccugagggccgauacuauauccucacagauugagcucgcuguacugcuuaguaacgaagguaucaucaauagcgaggacgaacaccuguuggcgcucgagcggaaacugaagaaaauguuagggcccuccgcaguugagauuggcaacggauguuucgaaacgaagcacaagugcaaucagacaugccuggaucguaucgccgcuggcaccuuuaacgccggggaguucucucuaccaacuuuugacagccucaauauuaccgcagccucacugaacgaugacggacuugauaaucauacaauauugcuguauuacaguaccgcugccuccagccucgcagugacucugaugcuugcgaucuucauugucuauauggugucucgcgacaacgucucauguaguaucugccuguga

SEQ ID NO: 149749 - RNA, 1755 nt, Artificial Sequence; identical to SEQ ID NO: 149063
  derived and/or modified sequence opt3 from hemagglutinin__InfluenzaB__AGX24161

SEQ ID NO: 149750 - RNA, 1755 nt, Artificial Sequence; identical to SEQ ID NO: 148836
  derived and/or modified sequence opt3 from hemagglutinin__InfluenzaB__AGX24172

SEQ ID NO: 149751 - RNA, 1755 nt, Artificial Sequence; identical to SEQ ID NO: 148836
  derived and/or modified sequence opt3 from hemagglutinin__InfluenzaB__AGX24183

SEQ ID NO: 149752 - RNA, 1755 nt, Artificial Sequence; identical to SEQ ID NO: 148836
  derived and/or modified sequence opt3 from hemagglutinin__InfluenzaB__AGX24194

SEQ ID NO: 149753 - RNA, 1755 nt, Artificial Sequence; identical to SEQ ID NO: 148583
  derived and/or modified sequence opt3 from hemagglutinin__InfluenzaB__AGX24205

SEQ ID NO: 149754 - RNA, 1755 nt, Artificial Sequence; identical to SEQ ID NO: 148747
  derived and/or modified sequence opt3 from hemagglutinin__InfluenzaB__AGX24227

SEQ ID NO: 149755 - RNA, 1755 nt, Artificial Sequence; identical to SEQ ID NO: 148836
  derived and/or modified sequence opt3 from hemagglutinin__InfluenzaB__AGX24238

SEQ ID NO: 149756 - RNA, 1755 nt, Artificial Sequence
  derived and/or modified sequence opt3 from hemagglutinin__InfluenzaB__AGX24249
augaaggccaucauugugcugcucauggucguuaccagcaacgcugacagaauaugcacaggcaucacuuccucuaaaucaccccacgugguaaagacggcaacccagggggaagugaaugucacaggagugauuccucuuacuaccacaccaaccaaaaguuacuucgccaaccugaaggguacuaggacacggggcaaauuguguccggauugcuuaaauuguaccgaccuggauguugcgcuagggcgccccaugugcgugggaacgacuccuagcgcuaaggccuccauccuccaugaaguccgaccagugaccucuggcuguuuucccauuaugcacgaccguacaaagaucagacaacugccuaaccuucugagggguuaugagaauauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaauaaaacucagaugaagaaccuguauggcgauucuaauccucaaaaguuuacaagcuccgcgaacggggugaccacgcacuacgucucacagaucggagacuucccagaucagaccgaggacggcggucucccccagagugggagaauaguuguggauuauaugaugcaaaaaccuggaaagacaggcacuauuguauaccagaggggcguguuacugccacagaaagucuggugcgcaagcgggcggucuaaggugaucaaaggaucccuucccuugauuggugaagccgacugucugcaugagaaguacggcgggcuaaauaaaucaaagccguauuacaccggagaacacgcuaaggccaucggcaacugcccuaucuggguuaaaacaccccucaagcuggcaaacgguacuaaauaucgcccuccagcuaagcugcugaaagagcgaggguuuuucggcgccauugcgggauuuuuggagggcgggugggaaggaaugauagccgguuggcacggcuacaccagccauggggcacacggaguggcugucgccgcugaccucaagaguacacaggaggccaucaauaagauuaccaaaaaccuuaauucuuuauccgaacuggaggugaagaaccuccaaagacuuagcggcgcaauggaugaacugcauaaugagaucuuggagcuagacgaaaaaguagaugaccugagggccgauacuauaucgucucagauugagcucgcuguucugcuuuccaacgaagguaucaucaauucagaggacgaacaccuguuggcgcucgagcggaagcugaaaaagauguuagggcccagugcaguggauauuggcaacggauguuucgagacgaagcacaaaugcaaucagacaugccuggaccguaucgccgcuggcaccuuuaacgccggggaguucagccuaccaacuuuugauucccucaauauuaccgcagccucucugaacgacgauggacuugacaaucauacaauauugcuguauuacagcaccgcugccucaagucucgcagucacucugaugcuugcgaucuucauuguguauauggucucccgcgacaacgugagcuguucuaucugccuguga

SEQ ID NO: 149757 - RNA, 1755 nt, Artificial Sequence; identical to SEQ ID NO: 148583
  derived and/or modified sequence opt3 from hemagglutinin__InfluenzaB__AGX24260

SEQ ID NO: 149758 - RNA, 1755 nt, Artificial Sequence; identical to SEQ ID NO: 149072
  derived and/or modified sequence opt3 from hemagglutinin__InfluenzaB__AGX24271

SEQ ID NO: 149759 - RNA, 1755 nt, Artificial Sequence
  derived and/or modified sequence opt3 from hemagglutinin__InfluenzaB__AGX24282
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacaaagggagaagaucagaucaccgugugggguuuccauucugacaauaaaacucagaugaagaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaaaccuggaaagacaggcacuauaguauaucagaggggcguguuacugccacagcgggucuggugcgcauccgggcgcucaaaagugauuaagggaagccuucccuugaucggugaggccgauugucugcaugaaaaauacggcgggcuaaacaagaguaaaccguacuauaccggagagcacgcuaaggccauuggcaauugcccuaucuggguuaagacaccccucaaacuggcaaacgguacuaaguaccgaccuccagcuaaacuucugaaggaaagaggguuuuucggcgccaucgcgggauuuuuggagggcgggugggagggaaugauugccgguuggcacggcuauaccucucauggggcacacggaguggcugucgccgcugaccucaaauccacacaggaagccauaaauaagaucaccaagaaccugaauagcuuaucggagcuggaagugaaaaaccuccaaaggcuuucuggcgcaauggacgagcugcauaaugaaauuuuggagcuagaugagaagguagacgaucugcgggccgacacuaucuccucacagauagaacucgcuguucugcuuaguaacgaggguauuaucaauagcgaagaugagcaccuguuggcgcucgaacguaaacugaagaaaauguuagggcccuccgcaguggagaucggcaacggauguuucgagacgaagcacaagugcaaucagacaugccuggaccgcauugccgcuggcaccuuuaacgccggggaguucucucuaccaacuuuugauagccucaauaucaccgcagccucacugaacgacgauggacuugacaaucauacaauuuugcuguacuauaguaccgcugccuccagccucgcagucacucugaugcuugcgauauucaucguguacauggucucuagagauaacgugucauguaguauuugccuguga

SEQ ID NO: 149760 - RNA, 1755 nt, Artificial Sequence; identical to SEQ ID NO: 148583
  derived and/or modified sequence opt3 from hemagglutinin__InfluenzaB__AGX24293

SEQ ID NO: 149761 - RNA, 1755 nt, Artificial Sequence; identical to SEQ ID NO: 148583
  derived and/or modified sequence opt3 from hemagglutinin__InfluenzaB__AGX24304

SEQ ID NO: 149762 - RNA, 1755 nt, Artificial Sequence; identical to SEQ ID NO: 149072
  derived and/or modified sequence opt3 from hemagglutinin__InfluenzaB__AGX24315

SEQ ID NO: 149763 - RNA, 1755 nt, Artificial Sequence
  derived and/or modified sequence opt3 from hemagglutinin__InfluenzaB__AGX24326
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccacgugcgugggaacuaccccuagcgcuaaagccuccauccuccaugaaguccgaccagugacaucuggcuguuuucccauuaugcacgaccguacuaagaucagacaacugccuaaucuucugagggguuaugagaacauacgguugucgacccagaauguaaucgaugcagaaaaggccccagggggacccuaccgccucggcacaucaggcagcugcccuaacgcuaccaguaaauccggguucuuugcaacgauggccugggcuguuccaaaggacaauaacaaaaaugccacuaacccgcugacaguggagguccccuauauuuguaccgaaggagaggaucagaucacugugugggguuuccauucugacaauaagacacagaugaaaaaccuguacggcgauagcaauccucaaaaguuuaccuccucagcgaacggggugacgacccacuaugucagucagauuggcagcuucccagaccagacagaggauggaggucucccccagucugggagaaucguuguggacuacaugaugcaaaagccuggaaaaacuggcaccauaguauaucagaggggcauuuuacugccacagaagguguggugcgcauccgggcggucaaaagucaucaagggaagccuucccuugauuggugaagccgauugucugcaugagaaauacggcgggcuaaacaagaguaaaccguacuauacaggagaacacgcuaaggccaucggcaauugcccuaucugggugaagacuccccucaaacuggcaaacgguaccaaguaccgcccuccagcuaaacuucugaaggagcgaggguuuuucggcgccauugcgggauuuuuggagggcgggugggaaggaaugauagccgguuggcacggcuauacaucucauggggcacacggaguugcuguggccgcugaccucaaauccacccaggaggccaucaauaagauuacuaagaaccugaauagcuuaucggaacuggaggucaaaaaccuccaaagacuuucuggcgcaauggacgaacugcauaaugagaucuuggagcuagaugaaaagguggacgaucugagggccgacacgauauccucacagauugagcucgcuguacugcuuaguaacgaagguaucaucaauagcgaggaugaacaccuguuggcgcucgagcggaaacugaagaaaauguuagggcccuccgcaguugagauuggcaacggauguuucgaaacaaagcacaagugcaaucagaccugccuggaccguaucgccgcuggcacuuuuaacgccggggaguucucucuaccaaccuuugauagccucaauauuacagcagccucacugaacgacgauggacuugacaaucauaccauauugcuguacuauaguacugcugccuccagccucgcagugacacugaugcuugcgaucuucauugucuacauggugucucgcgauaacgucucauguaguaucugccuguga

SEQ ID NO: 149764 - RNA, 1755 nt, Artificial Sequence
  derived and/or modified sequence opt3 from hemagglutinin__InfluenzaB__AGX24337
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggaugcccaugugcgugggaacgacuccuagcgcuaaagccuccauccuccaugaaguccgcccagugaccucuggcuguuuucccauuaugcacgaccgaacaaagauccgucaacugccuaaucuucugagagguuaugagaacauaagguugucgacucagaauguaaucgaugcagaaaaggccccagggggacccuaccggcucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggcgcauaguuguggauuauaugaugcaaaagccuggaaaaacaggcacuauuguauaccagagaggcguguuacugccacagaaggucuggugcgcaagcgggaggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucggccuccagcuaaacuucugaaggagcgcggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaacgacuuagcggcgcaauggaugaacugcauaacgagaucuuggagcuagacgaaaagguagaugaccugagagccgauacuauaucgucucagauugagcucgcuguucugcuuuccaaugaagguaucaucaacucagaggacgaacaccuguuggcgcucgagaggaaacugaagaaaauguuagggcccagugcaguggauauuggcaauggauguuucgagacgaagcacaagugcaaccagacaugccuggaccggaucgccgcuggcaccuuuaaugccggggaguucagccuaccaacuuuugauucccucaacauuaccgcagccucucugaaugacgauggacuugacaaccauacaauauugcuguauuacagcaccgcugccucaagucucgcagucacucugaugcuugcgaucuucauuguguauauggucucccgugacaaugugagcuguucuaucugccuguga

SEQ ID NO: 149765 - RNA, 1755 nt, Artificial Sequence; identical to SEQ ID NO: 148836
  derived and/or modified sequence opt3 from hemagglutinin__InfluenzaB__AGX24348

SEQ ID NO: 149766 - RNA, 1755 nt, Artificial Sequence; identical to SEQ ID NO: 148583
  derived and/or modified sequence opt3 from hemagglutinin__InfluenzaB__AGX24359

SEQ ID NO: 149767 - RNA, 1755 nt, Artificial Sequence; identical to SEQ ID NO: 148836
  derived and/or modified sequence opt3 from hemagglutinin__InfluenzaB__AGX24381

SEQ ID NO: 149768 - RNA, 1755 nt, Artificial Sequence
  derived and/or modified sequence opt3 from hemagglutinin__InfluenzaB__AGX24392
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagauucccuauaucuguacagaaggagaggaucagauuaccgucugggguuuccauucugacaauaagacucagaugaaaaaccuguacggcgauagcaauccucaaaaguuuacauccucagcgaacggggugaccacgcacuaugugagucagaucggcagcuucccagaccagaccgaggauggaggucucccccagucugggagaauagucguugacuacaugaugcaaaagccuggaaaaacaggcacuauuguguaucagaggggcguauuacugccacagaagguguggugcgcauccgggcggucaaaagucaucaagggaagccuucccuugauuggugaagccgauugucugcaugagaaauacggcgggcuaaacaagaguaaaccguacuauaccggagaacacgcuaaggccaucggcaauugcccuaucugggugaagacaccccucaaacuggcaaacgguacuaaguaccgcccuccagcuaaacuucugaaggagcgaggguuuuucggcgccauugcgggauuuuuggagggcgggugggaaggaaugauagccgguuggcacggcuauaccucucauggggcacacggaguugcuguggccgcugaccucaaauccacacaggaggccaucaauaagauuaccaagaaccugaauagcuuaucggaacuggaggucaaaaaccuccaaagacuuucuggcgcaauggacgaacugcauaaugagaucuuggagcuagaugaaaagguggacgaucugagggccgacacuauauccucacagauugagcucgcuguacugcuuaguaacgaagguaucaucaauagcgaggaugaacaccuguuggcgcucgagcggaaacugaagaaaauguuagggcccuccgcaguugagauuggcaacggauguuucgaaacgaagcacaagugcaaucagacaugccuggaccguaucgccgcuggcaccuuuaacgccggggaguucucucuaccaacuuuugauagccucaauauuaccgcagccucacugaacgacgauggacuugacaaucauacaauauugcuguacuauaguaccgcugccuccagccucgcagugacucugaugcuugcgaucuucauugucuacauggugucucgcgauaacgucucauguaguaucugccuguga

SEQ ID NO: 149769 - RNA, 1755 nt, Artificial Sequence; identical to SEQ ID NO: 148583
  derived and/or modified sequence opt3 from hemagglutinin__InfluenzaB__AGX24403

SEQ ID NO: 149770 - RNA, 1755 nt, Artificial Sequence; identical to SEQ ID NO: 148836
  derived and/or modified sequence opt3 from hemagglutinin__InfluenzaB__AGX24414

SEQ ID NO: 149771 - RNA, 1755 nt, Artificial Sequence; identical to SEQ ID NO: 148583
  derived and/or modified sequence opt3 from hemagglutinin__InfluenzaB__AGX24425

SEQ ID NO: 149772 - RNA, 1755 nt, Artificial Sequence; identical to SEQ ID NO: 148583
  derived and/or modified sequence opt3 from hemagglutinin__InfluenzaB__AGX24436

SEQ ID NO: 149773 - RNA, 1755 nt, Artificial Sequence; identical to SEQ ID NO: 149072
  derived and/or modified sequence opt3 from hemagglutinin__InfluenzaB__AGX24447

SEQ ID NO: 149774 - RNA, 1755 nt, Artificial Sequence; identical to SEQ ID NO: 149763
  derived and/or modified sequence opt3 from hemagglutinin__InfluenzaB__AGX24458

SEQ ID NO: 149775 - RNA, 1755 nt, Artificial Sequence
  derived and/or modified sequence opt3 from hemagglutinin__InfluenzaB__AGX24469
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccacgugcgugggaacuaccccuagcgcuaaagccuccauccuccaugaaguccgaccagugacaucuggcuguuuucccauuaugcacgaccguacuaagaucagacaacugccuaaucuucugagggguuaugagaacauacgguugucgacccagaauguaaucgaugcagaaaaggccccagggggacccuaccgccucggcacaucaggcagcugcccuaacgcuaccaguaaauccggguucuuugcaacgauggccugggcuguuccaaaggacaauaacaaaaaugccacuaacccgcugacaguggagguccccuauauuuguaccgaaggagaggaucagaucacugugugggguuuccauucugacaauaagacacagaugaaaaaccuguacggcgauagcaauccucaaaaguuuaccuccucagcgaacggggugacgacccacuaugucagucagauuggcagcuucccagaccagacagaggauggaggucucccccagucugggagaaucguuguggacuacaugaugcaaaagccuggaaaaacuggcaccauaguauaucagaggggcauuuuacugccacagaagguguggugcgcauccgggcggucaaaagucaucaagggaagccuucccuugauuggugaagccgauugucugcaugagaaauacggcgggcuaaacaagaguaaaccguacuauacaggagaacacgcuaaggccaucggcaauugcccuaucugggugaagacuccccucaaacuggcaaacgguaccaaguaccgcccuccagcuaaacuucugaaggagcgaggguuuuucggcgccauugcgggauuuuuggagggcgggugggaaggaaugguugccgguuggcacggcuauacaucucauggggcacacggaguggcugucgccgcugaccucaaauccacccaggaggccauaaauaagaucacuaagaaccugaauagcuuaucggaacuggaggugaaaaaccuccaaagacuuucuggcgcaauggacgaacugcauaaugagauuuuggagcuagaugaaaagguagacgaucugagggccgacacgaucuccucacagauagagcucgcuguucugcuuaguaacgaagguauuaucaauagcgaggaugaacaccuguuggcgcucgagcggaaacugaagaaaauguuagggcccuccgcaguggagaucggcaacggauguuucgaaacaaagcacaagugcaaucagaccugccuggaccguauugccgcuggcacuuuuaacgccggggaguucucucuaccaaccuuugauagccucaauaucacagcagccucacugaacgacgauggacuugacaaucauaccauuuugcuguacuauaguacugcugccuccagccucgcagucacacugaugcuugcgauauucaucguguacauggucucucgcgauaacgugucauguaguauuugccuguga

SEQ ID NO: 149776 - RNA, 1755 nt, Artificial Sequence; identical to SEQ ID NO: 149072
  derived and/or modified sequence opt3 from hemagglutinin__InfluenzaB__AGX24480

SEQ ID NO: 149777 - RNA, 1755 nt, Artificial Sequence; identical to SEQ ID NO: 149072
  derived and/or modified sequence opt3 from hemagglutinin__InfluenzaB__AGX24491

SEQ ID NO: 149778 - RNA, 1755 nt, Artificial Sequence
  derived and/or modified sequence opt3 from hemagglutinin__InfluenzaB__AGX24502
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguucagaaggacaauaacaaaaaugccacgaacccacugacuguggaggucccguauauuuguacagaaggagaggaucagaucaccgugugggguuuccauucugacaauaagacucaaaugaaaaaccuguacggcgauagcaauccccagaaguuuacauccucagcgaacggggugaccacgcacuaugucagucagauuggcagcuucccugaccagaccgaggauggaggucucccacaaucugggagaaucguuguggacuacaugaugcagaagcccggaaaaacaggcacuauaguauaucagaggggcguguuacugccucagcgggucuggugcgcauccgggcgcucaaaggugauuaaaggaagccuuccauugaucggugaagccgauugucugcaugagaaguacggcgggcuaaacaaaaguaagcccuacuauaccggagaacacgcuaaagccauuggcaauugcccgaucuggguuaagacaccucucaagcuggcaaacgguacuaaauaccgacccccagcuaaacuucugaaggagagaggguuuuucggcgccaucgcgggauuuuuggagggcgggugggaaggaaugauugccgguuggcacggcuauaccucucauggggcacacggaguggcugucgccgcugaccucaaguccacacaagaggccauaaauaaaaucaccaagaaccugaauagcuuaucggaacuggaggugaagaaccuccagaggcuuucuggcgcaauggacgaacugcauaaugagauuuuggagcuagaugaaaaaguagacgaucugcgggccgacacuaucuccucacagauagagcucgcuguucugcuuaguaacgaagguauuaucaauagcgaggaugaacaccuguuggcgcucgagcguaagcugaaaaagauguuagggccuuccgcaguggagaucggcaacggauguuucgaaacgaaacacaagugcaaucaaacaugccuggaccgcauugccgcuggcaccuuuaacgccggggaguucucucuacccacuuuugauagccucaauaucaccgcagccucacugaacgacgauggacuugacaaucauacaauuuugcuguacuauaguaccgcugccuccagccucgcagucacucugaugcuugcgauauucaucguguacauggucucuagagauaacgugucauguaguauuugccuguga

SEQ ID NO: 149779 - RNA, 1755 nt, Artificial Sequence; identical to SEQ ID NO: 148747
  derived and/or modified sequence opt3 from hemagglutinin__InfluenzaB__AGX24513

SEQ ID NO: 149780 - RNA, 1755 nt, Artificial Sequence; identical to SEQ ID NO: 149072
  derived and/or modified sequence opt3 from hemagglutinin__InfluenzaB__AGX24524

SEQ ID NO: 149781 - RNA, 1755 nt, Artificial Sequence
  derived and/or modified sequence opt3 from hemagglutinin__InfluenzaB__AGX24535
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaacugcauaacgagaucuuggagcuagacgaaaagguagaugaccugagggccgauacuauaucggcucagauugagcucgcgguucugcuuucuaaugaagguaucaucaacuccgaggacgaacaccuguuggcacucgagcggaaacugaagaaaauguuagggcccucagccguggauauuggcaauggauguuucgagacgaagcacaagugcaaccagacaugccuggaccguaucgcugccggcaccuuuaaugcaggggaguucagucuaccaacuuuugauagccucaacauuaccgccgcuucccugaaugacgauggacuugacaaccauacaauauugcuguauuacucuaccgccgcaagcucacucgcggucacucugaugcuugcuaucuucauuguguauauggucagucgcgacaauguguccuguagcaucugccuguga

SEQ ID NO: 149782 - RNA, 1755 nt, Artificial Sequence; identical to SEQ ID NO: 148583
  derived and/or modified sequence opt3 from hemagglutinin__InfluenzaB__AGX24546

SEQ ID NO: 149783 - RNA, 1755 nt, Artificial Sequence
  derived and/or modified sequence opt3 from hemagglutinin__InfluenzaB__AGX24557
augaagaccaucauugugcugcucauggucguuacaagcaacgccgacagaauaugcacuggcaucacguccucuaauucaccccacgugguaaaaaccgcuacacagggggaggugaacgucacuggagugauuccucuuaccacaaccccaacuaagaguuacuucgcaaaucugaaagguacaaggacccggggcaaguuguguccggauugcuuaaacuguacggaccuggauguugcccuagggcgccccacuugcgugggaaccacaccuagcgcgaaagcuagcauccuccaugaaguccgaccagugacuucuggcuguuuucccauuaugcacgaccguaccaagaucagacaacugccuaaucuucugagggguuaugagaacauacgguugucgacacagaauguaaucgaugccgaaaaggcaccagggggacccuaccgccucggcaccucaggcagcugcccuaacgccacgaguaaauccggguucuuugcuacuauggcaugggccguuccaaaggacaauaacaaaaaugcuacaaacccgcugaccguggagguccccuauauuuguacugaaggagaggaucagaucacagugugggguuuccauucugacaauaagacccagaugaaaaaccuguacggcgauagcaauccucaaaaguuuacguccucagccaacggggugaccacacacuaugucagucagauuggauccuucccagaccagacugaggauggcggucucccccagucugggagaaucguuguggacuacaugaugcaaaagccuggaaaaaccggcacaauaguauaucagaggggcauuuuacugccacagaagguguggugcgcguccgggcggucaaaagucaucaagggaagccuucccuugauuggugaagcagauugucugcaugagaaauacggcgggcuaaacaagaguaaaccguacuauacuggagaacacgccaaggcuaucggcaauugcccuaucugggugaagaccccucucaaacuggccaacgguacaaaguaccgcccacccgcaaaacuucugaaggagcgaggguuuuucggcgcuauugccggauuuuuggagggcgggugggaaggaaugauagcggguuggcacggcuauaccucucauggggcccacggaguugcaguggcugccgaccucaaauccacucaggaggcuaucaauaagauuacgaagaaccugaauagcuuaucggaacuggaggucaaaaaccuccaaagacuuucuggcgccauggacgaacugcauaaugagaucuuggagcuagaugaaaagguggacgaucugagggcagacacaauauccucacagauugagcucgccguacugcuuaguaacgaagguaucaucaauagcgaggaugaacaccuguuggcucucgagcggaaacugaagaaaauguuagggcccuccgcgguugagauuggcaacggauguuucgaaaccaagcacaagugcaaucagacuugccuggaccguaucgcagccggcaccuuuaacgcuggggaguucucucuaccaacauuugauagccucaauauuaccgccgcaucacugaacgacgauggacuugacaaucauacuauauugcuguacuauaguacagccgcuuccagccucgccgugacgcugaugcuugcaaucuucauugucuacauggugucucgcgauaacgucucauguaguaucugccuguga

SEQ ID NO: 149784 - RNA, 1755 nt, Artificial Sequence; identical to SEQ ID NO: 149072
  derived and/or modified sequence opt3 from hemagglutinin__InfluenzaB__AGX24579

SEQ ID NO: 149785 - RNA, 1755 nt, Artificial Sequence; identical to SEQ ID NO: 149072
  derived and/or modified sequence opt3 from hemagglutinin__InfluenzaB__AGX24590

SEQ ID NO: 149786 - RNA, 1755 nt, Artificial Sequence; identical to SEQ ID NO: 149072
  derived and/or modified sequence opt3 from hemagglutinin__InfluenzaB__AGX24601

SEQ ID NO: 149787 - RNA, 1755 nt, Artificial Sequence; identical to SEQ ID NO: 149072
  derived and/or modified sequence opt3 from hemagglutinin__InfluenzaB__AGX24612

SEQ ID NO: 149788 - RNA, 1755 nt, Artificial Sequence; identical to SEQ ID NO: 148583
  derived and/or modified sequence opt3 from hemagglutinin__InfluenzaB__AGX24623

SEQ ID NO: 149789 - RNA, 1755 nt, Artificial Sequence; identical to SEQ ID NO: 149072
  derived and/or modified sequence opt3 from hemagglutinin__InfluenzaB__AGX24634

SEQ ID NO: 149790 - RNA, 1755 nt, Artificial Sequence; identical to SEQ ID NO: 149781
  derived and/or modified sequence opt3 from hemagglutinin__InfluenzaB__AGX24656

SEQ ID NO: 149791 - RNA, 1755 nt, Artificial Sequence; identical to SEQ ID NO: 148583
  derived and/or modified sequence opt3 from hemagglutinin__InfluenzaB__AGX24667

SEQ ID NO: 149792 - RNA, 1755 nt, Artificial Sequence; identical to SEQ ID NO: 148836
  derived and/or modified sequence opt3 from hemagglutinin__InfluenzaB__AGX24678

SEQ ID NO: 149793 - RNA, 1755 nt, Artificial Sequence; identical to SEQ ID NO: 149072
  derived and/or modified sequence opt3 from hemagglutinin__InfluenzaB__AGX24689

SEQ ID NO: 149794 - RNA, 1755 nt, Artificial Sequence; identical to SEQ ID NO: 149072
  derived and/or modified sequence opt3 from hemagglutinin__InfluenzaB__AGX24700

SEQ ID NO: 149795 - RNA, 1755 nt, Artificial Sequence; identical to SEQ ID NO: 149072
  derived and/or modified sequence opt3 from hemagglutinin__InfluenzaB__AGX24711

SEQ ID NO: 149796 - RNA, 1755 nt, Artificial Sequence; identical to SEQ ID NO: 148583
  derived and/or modified sequence opt3 from hemagglutinin__InfluenzaB__AGX24722

SEQ ID NO: 149797 - RNA, 1755 nt, Artificial Sequence; identical to SEQ ID NO: 148583
  derived and/or modified sequence opt3 from hemagglutinin__InfluenzaB__AGX24733

SEQ ID NO: 149798 - RNA, 1755 nt, Artificial Sequence; identical to SEQ ID NO: 148583
  derived and/or modified sequence opt3 from hemagglutinin__InfluenzaB__AGX24744

SEQ ID NO: 149799 - RNA, 1755 nt, Artificial Sequence; identical to SEQ ID NO: 148583
  derived and/or modified sequence opt3 from hemagglutinin__InfluenzaB__AGX24755

SEQ ID NO: 149800 - RNA, 1755 nt, Artificial Sequence; identical to SEQ ID NO: 149072
  derived and/or modified sequence opt3 from hemagglutinin__InfluenzaB__AGX24766

SEQ ID NO: 149801 - RNA, 1755 nt, Artificial Sequence; identical to SEQ ID NO: 148583
  derived and/or modified sequence opt3 from hemagglutinin__InfluenzaB__AGX24777

SEQ ID NO: 149802 - RNA, 1755 nt, Artificial Sequence; identical to SEQ ID NO: 148583
  derived and/or modified sequence opt3 from hemagglutinin__InfluenzaB__AGX24788

SEQ ID NO: 149803 - RNA, 1755 nt, Artificial Sequence; identical to SEQ ID NO: 148583
  derived and/or modified sequence opt3 from hemagglutinin__InfluenzaB__AGX24799

SEQ ID NO: 149804 - RNA, 1755 nt, Artificial Sequence; identical to SEQ ID NO: 149072
  derived and/or modified sequence opt3 from hemagglutinin__InfluenzaB__AGX24810

SEQ ID NO: 149805 - RNA, 1755 nt, Artificial Sequence; identical to SEQ ID NO: 149072
  derived and/or modified sequence opt3 from hemagglutinin__InfluenzaB__AGX24821

SEQ ID NO: 149806 - RNA, 1755 nt, Artificial Sequence
  derived and/or modified sequence opt3 from hemagglutinin__InfluenzaB__AGX24832
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaagccuggaaaaacaggcacuauaguauaucagaggggcauuuuacugccacagcggguguggugcgcauccgggcgcucaaaggucaucaaaggaagccuucccuugauuggugaagccgauugucugcaugagaaguacggcgggcuaaacaaaaguaagccguacuauaccggagaacacgcuaaagccaucggcaauugcccuaucugggugaagacaccccucaagcuggcaaacgguacuaaauaccgaccuccagcuaaacuucugaaggagagaggguuuuucggcgccauugcgggauuuuuggagggcgggugggaaggaaugauagccgguuggcacggcuauaccucucauggggcacacggaguugcuguggccgcugaccucaaguccacacaggaggccaucaauaaaauuaccaagaaccugaauagcuuaucggaacuggaggucaagaaccuccaaaggcuuucuggcgcaauggacgaacugcauaaugagaucuuggagcuagaugaaaaaguggacgaucugcgggccgacacuauauccucacagauugagcucgcuguacugcuuaguaacgaagguaucaucaauagcgaggaugaacaccuguuggcgcucgagcguaagcugaaaaagauguuagggcccuccgcaguugagauuggcaacggauguuucgaaacgaaacacaagugcaaucagacaugccuggaccgcaucgccgcuggcaccuuuaacgccggggaguucucucuaccaacuuuugauagccucaauauuaccgcagccucacugaacgacgauggacuugacaaucauacaauauugcuguacuauaguaccgcugccuccagccucgcagugacucugaugcuugcgaucuucauugucuacauggugucuagagauaacgucucauguaguaucugccuguga

SEQ ID NO: 149807 - RNA, 1755 nt, Artificial Sequence
  derived and/or modified sequence opt3 from hemagglutinin__InfluenzaB__AGX24843
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugguacaaaagccuggaaaaacaggcacuauuguguaccagaggggcgucuuacugccacagcggguguggugcaccagcgggcgcucuaagguuaucaaaggaucccuucccuugauuggugaagcagacugucugcaugagaaguacggcgggcuaaacaaaucaaagccguauuacacaggagaacacgccaaagcuaucggcaacugcccuaucugggugaagacuccccucaagcuggccaaugguaccaaauaucgaccuccagcaaaacuucugaaggagagaggguuuuucggcgcuauugccggauuuuuggagggcgggugggaaggaaugauagcggguuggcacggcuacacaagccauggggcccacggagucgcaguggcugccgaccucaagaguacccaggaggcuaucaacaaaauuacuaagaaucugaacucuuuauccgaacuggagguaaagaaucuccaaaggcuuagcggcgccauggaugaacugcauaacgagaucuuggagcuagacgaaaaaguugaugaccugcgggcagauacgauaucgucucagauugagcucgccgugcugcuuuccaaugaagguaucaucaacucagaggacgaacaccuguuggcucucgagcguaagcugaaaaagauguuagggcccagugcggucgauauuggcaauggauguuucgagacaaaacacaagugcaaccagaccugccuggaccgcaucgcagccggcacuuuuaaugcuggggaguucagccuaccaaccuuugauucccucaacauuacagccgcaucucugaaugacgauggacuugacaaccauaccauauugcuguauuacagcacugccgcuucaagucucgccgugacacugaugcuugcaaucuucauugucuauaugguguccagagacaauguuagcuguucuaucugccuguga

SEQ ID NO: 149808 - RNA, 1755 nt, Artificial Sequence
  derived and/or modified sequence opt3 from hemagglutinin__InfluenzaB__AGX24854
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggaaugcuuaaacuguaccgaucuggacguugcgcuagggcgccccaugugcgugggaacgacuccuagcgcuaaagccuccauccuccaugagguccgaccagugaccucuggcuguuuucccauuaugcacgaucguacaaagaucagacaacugccuaaucuucugagggguuaugaaaacauacgguugucgacucagaauguaaucgacgcagagaaggccccagggggacccuaccgccucggcaccucaggcagcugcccuaacgcuacaaguaaaauuggguucuuugcaaccauggccugggcuguuccaaaggauaauuauaaaaacgccacgaauccgcugacuguggaaguccccuacaucugugcggagggagaggaccagauuacagugugggguuuccauuccgauaacaagacccagaugaaaaaucuguauggcgacucuaacccucaaaaguuuacuagcuccgcaaauggggugacaacccacuacgucucacagaucggagauuucccagaccagacggaagauggcggucucccccagagugggagaauaguuguggacuauaugguacaaaggccuggaaagaccggcacaauuguguaccagcggggcgucuuacugccacagaaaguguggugcgccagcgggcgcucuaagguuaucaaaggaucccuucccuugauuggugaggcugauugucugcaugaaaaguacggcgggcuaaacaaaucaaagccguauuacacuggagagcacgccaaagcaaucggcaacugcccuaucugggugaagaccccacucaagcuggcuaaugguacaaaauaucgacccccugccaaacuucugaaggagagaggguuuuucggcgcgauugccggauuuuuggaaggcgggugggagggaaugauagcagguuggcacggcuacacuagccauggggcucacggagucgccguggcugccgaccucaagaguacccaggaagcaaucaacaaaauuacaaagaaucugaacucuuuauccgagcuggaaguaaagaaucuccaaaggcuuagcggcgccauggacgagcugcauaacgagaucuuggaacuagaugagaaaguugacgaucugcgggcugacaccauaucgucucagauugaacucgcggugcugcuuuccaaugaggguaucaucaacucagaagaugagcaccuguuggcacucgagcguaagcugaaaaagauguuagggcccagugccgucgacauuggcaauggauguuucgaaacuaaacacaagugcaaccagacgugccuggaucgcaucgcugccggcacauuuaaugcaggggaguucagccuaccaaccuuugacucccucaacauuacugccgcuucucugaaugaugacggacuugauaaccauaccauauugcuguauuacagcacagccgcaucaagucucgcggugacccugaugcuugcuaucuucauugucuauaugguguccagagacaauguuagcuguucuaucugccuguga

SEQ ID NO: 149809 - RNA, 1755 nt, Artificial Sequence
  derived and/or modified sequence opt3 from hemagglutinin__InfluenzaB__AGX24865
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucugugcggaaggagaggaucagauuacagugugggguuuccauuccgacaacaagacccagaugaaaaaucuguauggcgauucuaacccucaaaaguuuacuagcuccgcaaauggggugacaacccacuacgucucacagaucggagacuucccagaucagacggaggacggcggucucccccagagugggagaauaguuguggauuauaugguacaaaggccuggaaagaccggcacaauuguguaccagcggggcgucuuacugccacagaaaguguggugcgccagcgggcgcucuaagguuaucaaaggaucccuucccuugauuggugaagcugacugucugcaugagaaguacggcgggcuaaacaaaucaaagccguauuacacuggagaacacgccaaagcaaucggcaacugcccuaucugggugaagaccccacucaagcuggcuaaugguacaaaauaucgacccccugccaaacuucugaaggagagaggguuuuucggcgcgauugccggauuuuuggagggcgggugggaaggaaugauagcagguuggcacggcuacacuagccauggggcucacggagucgccguggcugccgaccucaagaguacccaggaggcaaucaacaaaauuacaaagaaucugaacucuuuauccgaacuggagguaaagaaucuccaaaggcuuagcggcgccauggaugaacugcauaacgagaucuuggagcuagacgaaaaaguugaugaccugcgggcugauaccauaucgucucagauugagcucgcggugcugcuuuccaaugaagguaucaucaacucagaggacgaacaccuguuggcacucgagcguaagcugaaaaagauguuagggcccagugccgucgauauuggcaauggauguuucgagacuaaacacaagugcaaccagacgugccuggaccgcaucgcugccggcacauuuaaugcaggggaguucagccuaccaaccuuugauucccucaacauuacugccgcuucucugaaugacgauggacuugacaaccauaccauauugcuguauuacagcacagccgcaucaagucucgcggugacccugaugcuugcuaucuucauugucuauaugguguccagagacaauguuagcuguucuaucugccuguga

SEQ ID NO: 149810 - RNA, 1755 nt, Artificial Sequence
  derived and/or modified sequence opt3 from hemagglutinin__InfluenzaB__AGX24876
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacuaauucccugacgguggaggucccguacaucuguaaggaaggagaggaucagauuacagugugggguuuccauucugacaacaaaccccagaugaagaaucuguauggcgauagcaacccucaaaaguuuaccuccucagcgaauggggugacuacacacuacgucagucagguuggagacuucccagaucagaccgaggacggcggucucccccagagcgggagaaucgugguagauuauaugaugcaaaaaccuggaaggacgggcaccauaguguaccagcggggcgucuuacugccacagaagguguggugcgcaucugggcgcuccaaaguuauuaagggaucacuucccuugaucggugaagccgacugucugcaugagaaauacggcgggcuaaacaagagcaaaccguauuacacaggagaacacgcuaaggccauuggcaacugcccuaucugggugaagacuccccucaaacuggcaaaugguaccaaguaucgaccuccagcuaaacuucugaaggagagaggguuuuucggcgccaucgcgggauuuuuggagggcgggugggaaggaaugauugccgguuggcacggcuacacaagucauggggcacacggagucgcuguggccgcugaccucaaaucuacucaggaggccauaaacaagaucaccaagaaucugaacuccuuaagcgaacuggagguuaaaaaucuccaaaggcuuucgggcgcaauggaugaacugcauaacgagauuuuggagcuagacgaaaagguagaugaccugcgggccgauacaaucucuucccagauagagcucgcugugcugcuuucaaaugaagguauuaucaacagugaggacgaacaccuguuggcgcucgagcguaaacugaagaaaauguuagggcccagcgcagucgauaucggcaauggauguuucgagaccaagcacaagugcaaccagacuugccuggaccgcauugccgcuggcacguuuaaugccggggaguucucccuaccaacauuugauucucucaacaucaccgcagccagccugaaugacgauggacuugacaaccauacuauuuugcuguauuacucaaccgcugccaguucccucgcagugacacugaugcuugcgauauucaucgucuauauggugagcagagacaauguuucuuguucaauuugccuguga

SEQ ID NO: 149811 - RNA, 1755 nt, Artificial Sequence
  derived and/or modified sequence opt3 from hemagglutinin__InfluenzaB__AGX24887
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugccaccauggcuugggccguaccaaaggacaauuauaaaaacgcgacgaauccgcagacuguugaggugcccuacaucuguacagaaggagaggaucagauuaccgucugggguuuccauuccgacaacaagacucaaaugaaaaaucuguauggcgauucuaacccucagaaguuuacaagcuccgcaaauggggugaccacgcacuacgugucacagaucggagacuucccagaucagaccgaggacggcggucugccccaaagugggagaauagucguugauuauauggugcagaagccuggaaaaacaggcacuauuguauaccagaggggcgugcucuuaccacagaaggucuggugcgccagcgggcggucuaaagugaucaagggaucccugccccuuauuggugaagcugacuguuugcaugagaaauacggcgggcugaacaagucaaaaccguauuacaccggagaacacgccaaggcaaucggcaacugcccuaucuggguuaagacaccccuaaaacucgcuaaugguacuaaguaucgcccuccagccaaacugcuuaaggagcgaggguuuuucggcgcgauugccggauuucuggagggcgggugggaaggaaugauagcagguuggcacggcuacaccagccauggggcucacggaguggccgucgcugccgacuugaaaaguacacaagaggcaaucaacaagauuaccaagaaucucaacucucuguccgaauuagaggugaaaaaucugcagagacucagcggcgccauggaugaacuucauaacgagauccuggaguuggacgaaaagguagaugaccuaagggcugauacuaugucgucucagauagagcuggcgguucuccuguccaaugaagguauuaucaacucagaggacgaacaccuucuggcauuggagcggaaacucaagaaaaugcuggggcccagugccguggauaucggcaauggauguuucgagacgaagcacaagugcaaccaaacaugcuuagaccguauugcugccggcaccuuuaaugcaggggaguucagccugccaacuuuugauucccuaaacaucaccgccgcuucucucaaugacgauggacuggacaaccauacaauucuuuuguauuacagcaccgccgcaucaagucuggcggucacucucaugcuggcuauauucaucguguauauggucucccgcgacaaugugagcuguucuauuugccuuuga

SEQ ID NO: 149812 - RNA, 1755 nt, Artificial Sequence
  derived and/or modified sequence opt3 from hemagglutinin__InfluenzaB__AGX24898
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacaggaggugaagaucagauuaccguguggggcuuccauuccgacaauaaaacucagaugaagucucuguauggggauagcaacccucaaaaguuuacauccucagcgaauggagugaccacgcacuacgucagucagaucggcgacuucccagaucagaccgaggacggugggcucccccagagcggaagaauaguuguggauuauaugaugcaaaaaccuggcaagacaggcacuauuguauaccagaggggaguguuacugccacagaaagucuggugcgcaucugggcgguccaaggugaucaaagguucacuucccuugauuggcgaggccgacugucugcaugaaaaguacgggggacuaaacaaaagcaagccguauuacaccggcgagcacgcuaaggccaucgguaauugcccuaucuggguuaaaacaccccucaagcuggcaaacgggacuaaauaucgcccuccagcuaaacuucugaaggaacgaggcuuuuucggagccauugcgggcuuuuuggaagggggaugggaggguaugauagccggcuggcacggguacaccagucauggagcacacggcguggcugucgccgcugaccucaagucuacacaggaggccaucaacaagauuaccaaaaaucugaacuccuuaagcgagcuggaagugaagaaucuccaaagacuuucgggugcaauggaugagcugcauaacgaaaucuuggagcuagacgagaaaguagaugaccugagggccgauacuauaucuucccagauugaacucgcuguucugcuuucaaaugaggggaucaucaacagugaagacgagcaccuguuggcgcucgaacggaagcugaaaaagauguuaggccccagcgcaguggauauuggaaauggcuguuucgagacgaagcacaaaugcaaccagacaugccuggaccguaucgccgcugggaccuuuaaugccggagaguucucccuaccaacuuuugauucucucaacauuaccgcagccagccugaaugacgauggucuugacaaccauacaauauugcuguauuacucaaccgcugccaguucccucgcagucacucugaugcuugcgaucuucauuguguauauggucagccgcgacaaugugucuuguucaaucugccuguga

SEQ ID NO: 149813 - RNA, 1758 nt, Artificial Sequence; identical to SEQ ID NO: 148699
  derived and/or modified sequence opt3 from hemagglutinin__InfluenzaB__AGX84854

SEQ ID NO: 149814 - RNA, 1758 nt, Artificial Sequence
  derived and/or modified sequence opt3 from hemagglutinin__InfluenzaB__AGX84865
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugccccaacuguaccgauuuagacguggcgcuggggcggccuaagugcacgggaaagauuccaagcgcucgcguuuccauccuacacgaggugcgacccgucacuucuggcuguuuuccuauaaugcaugaucguaccaaaaucagacaacucccaaaucugcuuagggguuacgaacacauucggcugucgacacauaacgugaucaaugccgagaacgcacccgggggaccuuauaagauuggcacuucaggcagcugcccaaauguaaccaacgggaauggauucuuugccacaauggcuugggcaguuccgaaaaacgacaagaauaaaaccgccacgaaccccuugacuaucgaagugccuuacauauguacagagggugaggaucagauuaccgucuggggcuuccacagugacaaugaaacucagauggcuaagcucuauggggauuccaagccacagaaauuuacaucuagcgccaacggagugaccacgcacuacgugucccaaaucggcgguuuccccaaccagaccgaggacgggggacugccucagucaggccgcauugucguugauuauauggugcagaagaguggcaaaacagggacuaucaccuaccaaagaggaauccugcucccacagaagguauggugcgcgagcgguaggucuaaagugauuaagggcuccuuaccccugauaggggaagcagacugucuucaugagaaauauggaggcuugaauaagucaaagccguacuacacaggugagcacgccaaagcuaucgggaacugcccuauuugggucaagacuccccugaaacuagccaauggcaccaaguaucggccuccagcaaaacuccugaaggaacgcggauuuuucggcgcuaucgccggguuucuugagggagguugggaaggcaugauagcgggguggcauggauacacaagccacggcgcccacgguguggcaguugcugccgaucugaagaguacccaggaggcuauuaacaaaaucacuaagaauuugaacucucucuccgaacuggaggugaaaaauuuacagcgacugagcggggccauggacgagcuccauaacgaaauccuugagcuggaugaaaaggucgacgacuugagagcagauacgauuucgucucaaaucgagcuagccgugcugcucuccaaugaaggcauuauaaacucagaggacgagcaucugcuugcucuggaaaggaaauugaagaagaugcucggacccagugcgguagagaucggcaauggguguuucgaaacaaaacacaagugcaaccagaccugccuggaucggauugcagccggaacuuuugacgcuggugaguucagcuuaccaaccuuugauucccugaauaucacagccgcaucucuaaacgacgauggccucgacaaucacaccauccugcuuuauuacagcacugccgcuucaaguuuggccguuacacugaugauugcaauauucguggucuauauggugucccgugauaacgucagcuguucuaucugccucuga

SEQ ID NO: 149815 - RNA, 1758 nt, Artificial Sequence; identical to SEQ ID NO: 149814
  derived and/or modified sequence opt3 from hemagglutinin__InfluenzaB__AGX84876

SEQ ID NO: 149816 - RNA, 1758 nt, Artificial Sequence; identical to SEQ ID NO: 149814
  derived and/or modified sequence opt3 from hemagglutinin__InfluenzaB__AGX84887

SEQ ID NO: 149817 - RNA, 1758 nt, Artificial Sequence; identical to SEQ ID NO: 148699
  derived and/or modified sequence opt3 from hemagglutinin__InfluenzaB__AGX84898

SEQ ID NO: 149818 - RNA, 1758 nt, Artificial Sequence
  derived and/or modified sequence opt3 from hemagglutinin__InfluenzaB__AGX84920
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcuggcguguccauucuacacgagguccgccccgugacuucugguuguuuuccuaucaugcaugaucgaaccaaaauacgucaacucccaaaucugcuuagaggguacgaacacaucaggcugucgacacauaacguaauuaaugccgagaacgcacccggaggcccuuauaagaucggcacuucagggagcugcccaaauguuaccaacggaaaugguuucuuugccacaauggcuugggcagugccgaaaaacgacaagaauaaaaccgccacgaaccccuugacuauugaagucccuuacaucuguacagagggcgaggaucagauaaccguguggggguuccacagugacaaugaaacucagauggcuaagcucuauggagauuccaagccacagaaauuuacaucuagcgccaacggcgugaccacgcacuacgucucccaaauugguggguuccccaaccagaccgaggacggaggccugccucagucaggccggaucguuguggauuauaugguacagaagagugggaaaacaggaacuauuaccuaccaacgcgguauccugcucccacagaagguguggugcgcgagcggcagaucuaaagucaucaagggguccuuaccccugauuggagaagcagacugucuucaugagaaauauggcgguuugaauaagucaaagccguacuacacaggggagcacgccaaagcuauaggcaacugcccuaucugggugaagacuccccugaaacuagccaauggaaccaaguauaggccuccagcaaaacuccugaaggaacggggcuuuuucggggcuauugccggauuucuugaggguggcugggaagggaugaucgcgggauggcauggcuacacaagccacggugcccacgggguugcaguggcugccgaucugaagaguacccaggaggcuauaaacaaaauuacuaagaauuugaacucucucuccgaacuggaggucaaaaauuuacagcgccugagcggcgccauggacgagcuccauaacgaaauccuugagcuggaugaaaagguggacgacuugcgagcagauacgaucucgucucaaauugagcuagccguacugcucuccaaugaaggaaucauuaacucagaggacgagcaucugcuugcucuggaaagaaaauugaagaagaugcucggccccagugcgguugagauagggaauggauguuucgaaacaaaacacaagugcaaccagaccugccuggauaggaucgcagccgguacuuuugacgcuggcgaguucagcuuaccaaccuuugauucccugaauauuacagccgcaucucuaaacgacgaugggcucgacaaucacaccauccugcuuuauuacagcacugccgcuucaaguuuggccgugacacugaugaucgcaauuuucgucguguauauggucucccgggauaacgugagcuguucuauaugccucuga

SEQ ID NO: 149819 - RNA, 1758 nt, Artificial Sequence
  derived and/or modified sequence opt3 from hemagglutinin__InfluenzaB__AGZ59821
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuuaacuguaccgauuuagacguugcgcuggggcggcccaagugcacgggaaauaucccuagcgcuaaaguguccauucuacacgaaguccgcccagugacuucuggcuguuuccccaucaugcaugaucgaaccaagguacgucaacucccuaaccugcuuagagguuacgagcacauaaggcugucgacacauaauguuaucaacgccgaaaaagcaccagggggacccuauaagauuggcacuucaggcagcugcccuaaugugaccaacgggaauggauuuuucgccacaauggcuugggcagucccgaaaaacgacaauaacaagaccgccacgaauaguuugacuaucgaggugccauacauuuguacagaaggugaggaucagaucaccguguggggcuuucacuccgacaacgagacucagauggcuaagcucuauggggauucuaaaccccagaaguucacaagcuccgccaacggagucaccacgcacuacguuucacaaauaggcgguuuuccuaaucagaccgaagacgggggacugccacagaguggccggauugugguagauuauauggugcagaaaagcggcaagacagggacuaucaccuaccaacgcgguauucugcucccccagaaagucuggugcgcgucuggaagauccaaggugaucaaaggcucauuaccucugaucggggaggcagacugucuucaugaaaaguauggaggcuugaacaagagcaaaccauacuacacaggugagcacgccaaggcuauugggaauugccccauauggguuaaaacuccgcugaagcuagccaacggcaccaaauauaggccucccgcaaagcuccugaaggagcggggauucuuuggcgcuaucgccggguuccuugaaggagguugggagggcaugauugcgggguggcauggauacacaagucacggcgcccacgguguggcagucgcugccgaucugaaaucuacccaggaagcuaucaauaagauaacuaaaaaccuuaauucccucagcgagcuggaagugaagaacuuacagcgccugucgggggccauggacgagcuccauaaugagauucuugaacuggaugagaaaguagacgacuugcgagcagauacgaucucuucccaaaucgaacuagccguucugcucucaaacgagggcauuaucaauagugaagacgagcaccuguuggcucuggagagaaaguugaagaaaaugcucggaccaagcgcgguggaaauuggcaacggguguuuugagacaaagcauaaaugcaaucagaccugccuggauaggauagcagccggaacuuucgacgcuggugaauuuuccuuaccuaccuucgauucucugaacaucacagccgcaagccuaaaugacgauggccucgacaaccacaccauucugcuuuauuacucaacugccgcuaguuccuuggccgucacacugaugaucgcaaucuucguggucuauauggugagccgggauaacguuucuuguucaauuugccucuga

SEQ ID NO: 149820 - RNA, 1758 nt, Artificial Sequence
  derived and/or modified sequence opt3 from hemagglutinin__InfluenzaB__AGZ59832
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauguuaccaacgggaauggauucuuugccacaauggcuugggcagugccgaaaaacgacaauaacaagaccgccacgaauagucucacuauugaggucccauacaucuguacagaaggugaggaucagauaaccguguggggcuuccacuccgacaacgagacucagauggcuaagcuguauggggauucuaaaccccagaaguuuacaagcuccgccaacggagugaccacgcacuacgucucacaaauuggcgguuucccuaaucagaccgaagacgggggacugccacagaguggccggaucguuguggauuauaugguacagaaaagcggcaagacagggacuauuaccuaccaacgcggaauccucuuaccccagaaaguguggugcgcgucugguaaguccaaagucaucaagggcucacugccucuuauuggggaggcagacuguuugcaugaaaaguauggaggccugaacaaaagcaagccauacuacacaggugagcacgccaaagcuauagggaauugccccaucugggugaagacuccgcuaaaacucgccaacggcaccaaguauagaccucccgcaaagcugcuuaaagagaggggauuuuucggcgcuauugccggguuucuggaaggagguugggagggcaugaucgcgggguggcauggauacacaagucacggcgcccacgguguugcaguggcugccgauuugaagucuacccaggaagcuauaaauaaaauuacuaagaaccucaauucccugagcgaguuagaagucaaaaaccugcagcggcucucgggggccauggacgagcuucauaaugagauccuggaauuggaugagaagguggacgaccuacgcgcagauacgaucucuucccaaauugaacuggccguacuccugucaaacgagggcaucauuaauagugaagacgagcaccuucuggcuuuggagcgaaagcucaaaaagaugcugggaccaagcgcgguugaaauaggcaacggguguuucgagacaaaacauaagugcaaucagaccugcuuagauagaaucgcagccggaacuuuugacgcuggugaguucucccugccuaccuuugauucucuaaacauuacagccgcaagccucaaugaagacggccuggauaaccacaccauccuuuuguauuacucaacugccgcuaguucccuggccgugacacucaugaucgcaauuuucgucguguauauggucagcagggacaacgugucuuguucaauaugccuguga

SEQ ID NO: 149821 - RNA, 1758 nt, Artificial Sequence
  derived and/or modified sequence opt3 from hemagglutinin__InfluenzaB__AGZ59843
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucauagucuauauggugagccgugauaaugucucuuguucaaucugccuguga

SEQ ID NO: 149822 - RNA, 1758 nt, Artificial Sequence; identical to SEQ ID NO: 149168
  derived and/or modified sequence opt3 from hemagglutinin__InfluenzaB__AGZ59854

SEQ ID NO: 149823 - RNA, 1758 nt, Artificial Sequence; identical to SEQ ID NO: 148530
  derived and/or modified sequence opt3 from hemagglutinin__InfluenzaB__AGZ59865

SEQ ID NO: 149824 - RNA, 1758 nt, Artificial Sequence
  derived and/or modified sequence opt3 from hemagglutinin__InfluenzaB__AGZ59876
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaaaaacaagaccgccacgaauagucucacuauugaagucccguacaucuguacagagggugaggaucagauaaccguguggggcuuccacuccgacaacgaaacucagauggcuaaacuguauggggauucuaagccccagaaguuuacaagcuccgccaacggagugaccacgcacuacgucucacaaauuggcgguuucccuaaucagaccgaggacgggggacugccacagaguggccgcaucguuguggauuauaugguacagaaaagcggcaagacagggacuauuaccuaccaaagaggaauccucuuaccccagaaaguguggugcacaucugguagguccaaggucaucaaaggcucacugccucuuauuggggaagcggacuguuugcaugagaaguauggaggccugaacaaaagcaagccauacuacacuggugagcacgcaaaggccauagggaauugccccaucugggugaaaaccccgcuaaagcucgcuaacggcacaaaauaucggccucccgccaagcugcuuaaagaacgcggauuuuucggcgcaauugcuggguuucuggagggagguugggaaggcaugaucgccggguggcauggauacaccagucacggcgcgcacgguguugccguggcagcugauuugaagucuacucaggaggccauaaauaagauuacgaaaaaccucaauucccugagcgaauuagaggucaagaaccugcagcgacucucgggggcuauggacgagcuucauaaugaaauccuggaguuggaugaaaaaguggacgaccuaagagccgauacaaucucuucccaaauugagcuggcaguacuccugucaaacgaaggcaucauuaauagugaggacgagcaccuucuggccuuggaaaggaagcucaaaaagaugcugggaccaagcgcuguugagauaggcaacggguguuucgaaaccaagcauaaaugcaaucagacuugcuuagaucggaucgcggcaggaaccuuugacgccggugaguucucccugccuacauuugauucucuaaacauuaccgcugccagccucaaugacgauggccuggacaaccacacuauccuuuuguauuacucaacagcagccaguucccuggcugugacgcucaugaucgccauuuucgucguguauauggucagccgugauaacgugucuuguucaauaugccuguga

SEQ ID NO: 149825 - RNA, 1755 nt, Artificial Sequence; identical to SEQ ID NO: 148583
  derived and/or modified sequence opt3 from hemagglutinin__InfluenzaB__AGZ59887

SEQ ID NO: 149826 - RNA, 1758 nt, Artificial Sequence; identical to SEQ ID NO: 149005
  derived and/or modified sequence opt3 from hemagglutinin__InfluenzaB__AGZ59898

SEQ ID NO: 149827 - RNA, 1758 nt, Artificial Sequence; identical to SEQ ID NO: 149371
  derived and/or modified sequence opt3 from hemagglutinin__InfluenzaB__AGZ59909

SEQ ID NO: 149828 - RNA, 1758 nt, Artificial Sequence; identical to SEQ ID NO: 149005
  derived and/or modified sequence opt3 from hemagglutinin__InfluenzaB__AGZ59920

SEQ ID NO: 149829 - RNA, 1758 nt, Artificial Sequence; identical to SEQ ID NO: 149005
  derived and/or modified sequence opt3 from hemagglutinin__InfluenzaB__AGZ59931

SEQ ID NO: 149830 - RNA, 1758 nt, Artificial Sequence; identical to SEQ ID NO: 149005
  derived and/or modified sequence opt3 from hemagglutinin__InfluenzaB__AGZ59942

SEQ ID NO: 149831 - RNA, 1758 nt, Artificial Sequence; identical to SEQ ID NO: 149005
  derived and/or modified sequence opt3 from hemagglutinin__InfluenzaB__AGZ59953

SEQ ID NO: 149832 - RNA, 1758 nt, Artificial Sequence
  derived and/or modified sequence opt3 from hemagglutinin__InfluenzaB__AGZ59965
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcgucguuguggauuauaugaugcagaagaguggcaaaacagggacuauuaccuaccaaagaggaauccucuuaccucagaagguauggugcgcgagcgguaggucuaaagugaucaagggcucccugccacuuauuggggaagcagacuguuugcaugagaaauauggaggccugaauaagucaaagcccuacuacacaggugagcacgccaaagcuauagggaacugcccgaucugggucaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguggcaguugcugccgauuugaagaguacccaggaggcuauaaacaaaauuacuaagaaucucaacucucuguccgaauuagaggugaaaaaucugcagcgacucagcggggccauggacgagcuucauaacgaaauccuggaguuggaugaaaaggucgacgaccuaagagcagauacgaucucgucucaaauugagcuggccgugcuccuguccaaugaaggcaucauuaacucagaggacgagcaccuucuggcuuuggaaaggaaacucaagaagaugcugggaccuagugcgguagagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccguuacacucaugaucgcaauuuucguggucuauauggugucccgugauaacgucagcuguucuauaugccuguga

SEQ ID NO: 149833 - RNA, 1758 nt, Artificial Sequence; identical to SEQ ID NO: 149005
  derived and/or modified sequence opt3 from hemagglutinin__InfluenzaB__AGZ59976

SEQ ID NO: 149834 - RNA, 1758 nt, Artificial Sequence; identical to SEQ ID NO: 149005
  derived and/or modified sequence opt3 from hemagglutinin__InfluenzaB__AGZ59987

SEQ ID NO: 149835 - RNA, 1758 nt, Artificial Sequence; identical to SEQ ID NO: 149005
  derived and/or modified sequence opt3 from hemagglutinin__InfluenzaB__AGZ59999

SEQ ID NO: 149836 - RNA, 1758 nt, Artificial Sequence; identical to SEQ ID NO: 148624
  derived and/or modified sequence opt3 from hemagglutinin__InfluenzaB__AGZ60010

SEQ ID NO: 149837 - RNA, 1758 nt, Artificial Sequence; identical to SEQ ID NO: 148624
  derived and/or modified sequence opt3 from hemagglutinin__InfluenzaB__AGZ60021

SEQ ID NO: 149838 - RNA, 1758 nt, Artificial Sequence; identical to SEQ ID NO: 148624
  derived and/or modified sequence opt3 from hemagglutinin__InfluenzaB__AGZ60033

SEQ ID NO: 149839 - RNA, 1755 nt, Artificial Sequence
  derived and/or modified sequence opt3 from hemagglutinin__InfluenzaB__AGZ60044
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaacgccccagggggacccuaccgccucggcaccucaggcagcugcccuaaugcuacaaguaaguccggguucuuugcaaccauggccugggcuguuccaaaagacaacaauaagaacgccacgaauccgcugacuguggagguccccuauguguguacagaaggagaggaucagauuaccgugugggguuuccauucugacaacaaaacucagaugaagaaucuguacggcgauagcaacccucaaaaauuuacauccucagcgaacggggucaccacgcacuauguuagucagaucggaggcuucccagcacagaccgaggacggugggcucccccagagcggaagaauugugguagauuacauggugcaaaagccuaggaagacaggcacuaucgucuaucagcggggcguguuacugccacagaaaguuuggugcgccucugggcgcuccaaggugauaaaaggaucacuucccuugauuggugaagcugacugucugcaugagaaguacggcgggcuaaauaaaagcaagccguacuauaccggagaacacgccaaagcaaucggcaacugcccuauuugggucaagacaccccucaagcuggcuaaugguacuaaauaccgaccuccagccaaacuucugaaggagagaggguuuuucggcgcgaucgccggauuuuuggagggcgggugggaaggaaugaucgcagguuggcacggcuauaccagucauggggcucacggaguggccguagcugccgaucucaagucuacacaggaggcaauuaacaaaauaaccaagaaucugaacuccuuaagcgaacuggagguuaagaaucuccaaaggcuuucgggcgccauggacgaacugcauaacgagaucuuggagcuagacgaaaaaguggaugaccugcgggcugauacuauuucuucccagaucgagcucgcgguccugcuuucaaaugaagguauaauuaacagugaggacgaacaccuguuggcacucgagcguaagcugaaaaagauguuagggcccagcgccguggauaucggcaauggauguuucgagacgaaacacaagugcaaccagacaugccuggaccgcaucgcugccggcaccuuuaaugcaggggaguucucccuaccaacuuuugauucucucaacauuaccgccgcuagccugaaugacgauggacuugacaaccauacaaucuugcuguacuauucaaccgccgcaaguucccucgcggucacucugaugcuugcuauuuucauaguguacaugguuagcagagauaacgugucuuguucaaucugccuguga

SEQ ID NO: 149840 - RNA, 1755 nt, Artificial Sequence; identical to SEQ ID NO: 149042
  derived and/or modified sequence opt3 from hemagglutinin__InfluenzaB__AGZ60055

SEQ ID NO: 149841 - RNA, 1755 nt, Artificial Sequence
  derived and/or modified sequence opt3 from hemagglutinin__InfluenzaB__AGZ60066
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaggacacggggcaaguuguguccggauugcuuaaacuguaccgaccuggauguugcgcuagggcgccccaugugcgugggaacgacuccuagcgcuaaagccuccauccuccacgaaguccgaccagugaccucuggcuguuuucccauuaugcaugaccguacaaagaucagacaacugccuaaucuucugagggguuacgagaacauacgguugucgacucagaauguaaucgaugcagaaaaggcccucgggggaccauaucgccugggcaccucaggcagcugccccaacgcuacaaguaaauccggguucuuugcaaccauggccugggcuguuccuaaggacaauaacaaaaaugccacgaacccacugacuguggaggucccguacauuuguacagaaggagaggaucagaucaccgugugggguuuccacucugacaauaagacucagaugaaaaaccucuauggcgauagcaauccccaaaaguuuacauccucagcgaacggggugaccacgcauuacgucagucagauuggaggcuucccugaccagaccgaggaugguggguuaccacagagcggaagaaucguuguggacuauaugguacaaaagcccggcaaaacaggcacuauaguguaccagcgcgggguccugcuuccucagaagguguggugcgcaucuggacgguccaaaguuauuaaggguucauugccacugaucggcgaagccgauugucuacacgagaaauaugggggacucaacaagagcaaacccuacuacaccggcgaacacgcuaaggccauugguaauugcccgaucugggugaagacaccucugaaacuugcaaacgggacuaaguauaggcccccagcuaaacuguugaaggagcgaggcuuuuucggagccaucgcgggcuuucucgaagggggaugggaagguaugauugccggcuggcauggguacaccagucacggagcacauggcgucgcuguggccgcugaccugaaaucuacacaggaggccauaaauaagaucaccaagaacuuaaauucccugagcgaacucgagguuaaaaaccuucaaagacugucgggugcaauggacgaauugcacaaugagauucuagagcuggaugaaaagguagacgaucucagggccgacacuaucucuucccagauagagcuggcugugcuucugucaaacgaagggauuaucaauagugaggaugaacacuugcucgcgcuggagcggaaauuaaagaaaaugcugggcccuagcgcagucgacaucggaaacggcuguuucgagacgaagcauaagugcaaucagacaugccuagaucguauugccgcugggaccuuuaacgccggagaguucucccuccccacuuuugacucucugaauaucaccgcagccagccuuaacgaugacgguuuggauaaucacacaauucugcucuauuacucaaccgcugccaguucccuggcagugacucuuaugcuggcgauauucaucgucuauauggugagccgcgacaacguuucuuguucaauuugcuuguga

SEQ ID NO: 149842 - RNA, 1755 nt, Artificial Sequence
  derived and/or modified sequence opt3 from hemagglutinin__InfluenzaB__AGZ60077
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggagccccaugugcgugggaacgacuccuuccgcuaaagccucuauccuccaugaaguccgcccagugaccucgggcuguuuucccauuaugcacgaccgaacaaagauccgucaacuggcaaaucuucugagagguuaugagaacauaagguugucaacucagaauguaaucgaugccgaaaaggcuccugggggaccauaccggcucggcaccagcggcaguugccccaacgcaacauccaaaucuggguucuuugccaccauggcuugggccguuccuaaggacaauaacaaaaaugcgacgaacccacugacuguggaggucccguauauuuguacagaaggagaggaucagaucaccgugugggguuuccauagcgacaauaagacucagaugaaaaaccuguacggcgauuccaauccccaaaaguuuacaucaagugcaaacggggugaccacgcacuaugucagccagauuggaggcuucccugaccagaccgaggauggugggcucccacagucuggacgcaucguuguggacuacaugaugcaaaaguccggcaaaacaggcacuauaguauaucagagagggguguuacugccccagaaggucuggugcgccucaggaaggagcaaagugauuaaggguagucuuccuuugaucggcgaagcugauugucugcaugagaaauacgggggacuaaacaagucuaaaccauacuauaccggcgaacacgccaaggcaauugguaauugccccaucuggguuaagacaccgcucaaacuggcuaacgggacuaaguaccggccucccgccaaacuucugaaggagcgcggcuuuuucggagcgaucgccggcuuuuuggaagggggaugggaagguaugauugcaggcuggcacggguauaccucccauggagcucacggcguggccgucgcugccgaccucaaaagcacacaggaggcaauaaauaagaucaccaagaacuuaaauucgcugucugaacuggaggugaaaaaccuccaacgacuuuccggugccauggacgaacugcauucagagauuuuggagcuagaugaaaagguagacgaucugagagcugacacuaucaguagccagauagagcucgcgguucugcuuuccaaugaagggauuaucaacucugaggaugaacaccuguuggcacucgagaggaaacugaagaaaauguuaggcccaagcgccguggacaucggaaauggcuguuucgagacgaagcacaagugcaaccagacaugccuggaucggauugcugccgggaccuuuaaugcaggagaguucucacuaccuacuuuugacagucucaacaucaccgccgcuucccugaaugaugacggucuugauaaccauacaauuuugcuguacuauagcaccgccgcaucuucacucgcggucacucugaugcuugcuauauucaucguguacauggucagucgugacaaugugagcuguuccauuugccuguga

SEQ ID NO: 149843 - RNA, 1755 nt, Artificial Sequence; identical to SEQ ID NO: 148747
  derived and/or modified sequence opt3 from hemagglutinin__InfluenzaB__AGZ60088

SEQ ID NO: 149844 - RNA, 1755 nt, Artificial Sequence; identical to SEQ ID NO: 148442
  derived and/or modified sequence opt3 from hemagglutinin__InfluenzaB__AGZ60099

SEQ ID NO: 149845 - RNA, 1755 nt, Artificial Sequence
  derived and/or modified sequence opt3 from hemagglutinin__InfluenzaB__AGZ60131
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccaauuaccucuggcuguuuucccaucaugcacgaccguacaaagauaagacaacugccuaaucuucugagggguuaugagaacauccgguugucgacucagaaugugauugaugcagaaaaggccccagggggacccuaccgccucggcaccucaggcagcugcccuaacgcuacaaguaaauccggguucuuugcaaccauggccugggcuguaccaaaggacaauaacaaaaaugccacgaacccgcugacuguugaggugcccuauaucuguacagaaggagaggaucagauuaccgucugggguuuccauucugacaauaagacucagaugaaaaaccuguacggcgauagcaauccucaaaaguuuacauccucagcgaacggggugaccacgcacuaugugagucagaucggcagcuucccagaccagaccgaggauggaggucucccccagucugggagaauagucguugacuacaugaugcaaaagccuggaaaaacaggcacuauuguguaucagaggggcguauuacugccacagaagguguggugcgcauccgggcggucaaaagucaucaagggaagccuucccuugauuggugaagccgauugucugcaugagaaauacggcgggcuaaacaagaguaaaccguacuauaccggagaacacgcuaaggccaucggcaauugcccuaucugggugaagacaccccucaaacuggcaaacgguacuaaguaccgcccuccagcuaaacuucugaaggagcgaggguuuuucggcgccauugcgggauuuuuggagggcgggugggaaggaaugauagccgguuggcacggcuauaccucucauggggcacacggaguugcuguggccgcugaccucaaauccacacaggaggccaucaauaagauuaccaagaaccugaauagcuuaucggaacuggaggucaaaaaccuccaaagacuuucuggcgcaauggacgaacugcauaaugagaucuuggagcuagaugaaaagguggacgaucugagggccgacacuauauccucacagauugagcucgcuguacugcuuaguaacgaagguaucaucaauagcgaggaugaacaccuguuggcgcucgagcggaaacugaagaaaauguuagggcccuccgcaguugagauuggcaacggauguuucgaaacgaagcacaagugcaaucagacaugccuggaccguaucgccgcuggcaccuuuaacgccggggaguucucucuaccaacuuuugauagccucaauauuaccgcagccucacugaacgacgauggacuugacaaucauacaauauugcuguacuauaguaccgcugccuccagccucgcagugacucugaugcuugcgaucuucauugucuacauggugucucgcgauaacgucucauguaguaucugccuguga

SEQ ID NO: 149846 - RNA, 1755 nt, Artificial Sequence; identical to SEQ ID NO: 148747
  derived and/or modified sequence opt3 from hemagglutinin__InfluenzaB__AGZ60142

SEQ ID NO: 149847 - RNA, 1755 nt, Artificial Sequence; identical to SEQ ID NO: 148747
  derived and/or modified sequence opt3 from hemagglutinin__InfluenzaB__AGZ60160

SEQ ID NO: 149848 - RNA, 1755 nt, Artificial Sequence; identical to SEQ ID NO: 148836
  derived and/or modified sequence opt3 from hemagglutinin__InfluenzaB__AGZ60172

SEQ ID NO: 149849 - RNA, 1755 nt, Artificial Sequence; identical to SEQ ID NO: 148836
  derived and/or modified sequence opt3 from hemagglutinin__InfluenzaB__AGZ60183

SEQ ID NO: 149850 - RNA, 1755 nt, Artificial Sequence
  derived and/or modified sequence opt3 from hemagglutinin__InfluenzaB__AGZ60194
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagacaggaaaaacuggcaccauuguauaccagaggggcguguuacugccucagaaggucuggugcgcaagcgggcggucuaaagugaucaagggaucccuuccauugauuggugaagccgacugucugcaugagaaauacggcgggcuaaacaagucaaaacccuauuacacaggagaacacgcuaaggccaucggcaacugcccgaucuggguuaagacuccucucaaacuggcaaaugguaccaaguaucgacccccagcuaaacuucugaaggagcgcggguuuuucggcgccauugcgggauuuuuggagggcgggugggaaggaaugauagccgguuggcacggcuacacaagccauggggcacacggaguggcugucgccgcugaccucaaaaguacccaggaggccaucaacaagauuacuaagaaucugaacucuuuauccgaacuggaggugaaaaaucuccaaagacuuagcggcgcaauggaugaacugcauaacgagaucuuggagcuagacgaaaagguagaugaccugagggccgauacgauaucgucucagauugagcucgcuguucugcuuuccaaugaagguaucaucaacucagaggacgaacaccuguuggcgcucgagcggaaacugaagaaaauguuagggccuagugcaguggauauuggcaauggauguuucgagacaaagcacaagugcaaccagaccugccuggaccguaucgccgcuggcacuuuuaaugccggggaguucagccuacccaccuuugauucccucaacauuacagcagccucucugaaugacgauggacuugacaaccauaccauauugcuguauuacagcacugcugccucaagucucgcagucacacugaugcuugcgaucuucauuguguauauggucucccgcgacaaugugagcuguucuaucugccuguga

SEQ ID NO: 149851 - RNA, 1755 nt, Artificial Sequence
  derived and/or modified sequence opt3 from hemagglutinin__InfluenzaB__AGZ60206
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaucaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauucuccaugaaguccgaccagugacuucuggcuguuuucccaucaugcacgaccguaccaagauaagacaacugccuaaucuucugagggguuaugagaacauccgguugucgacacagaauguaauugaugcagaaaaggccccagggggacccuaccgccucggcacuucaggcagcugcccuaacgcuaccaguaaaaucggguucuuugcaacaauggccugggcuguuccaaaggacaauuauaaaaacgccaccaauccgcugacgguggagguccccuacauuuguacugaaggagaggaucagaucacagugugggguuuccauuccgacaacaagacccagaugaaaaaucuguauggcgauucuaacccucaaaaguuuacuagcuccgcgaauggggugacaacccacuacgucucacagauaggagacuucccagaucagacggaggacggcggucucccccagagugggagaauuguuguggauuauaugaugcaaaagccuggaaaaaccggcacaaucguauaccagaggggcguguuacugccacagaaggucuggugcgcaagcgggcggucuaaagugauuaagggaucccuucccuugaucggugaagccgacugucugcaugagaaauacggcgggcuaaacaagucaaaaccguauuacacuggagaacacgcuaaggccaucggcaacugcccuauuuggguuaagaccccucucaaacuggcaaaugguacaaaguaucgcccacccgcuaaacuucugaaggagcgaggguuuuucggcgccauagcgggauuuuuggagggcgggugggaaggaaugaucgccgguuggcacggcuacacuagccauggggcacacggaguggcugucgccgcugaccucaaaaguacccaggaggccauuaacaagaucacaaagaaucugaacucuuuauccgaacuggaggugaaaaaucuccaaagacuuagcggcgcaauggaugaacugcauaacgagauauuggagcuagacgaaaagguagaugaccugagggccgauaccauuucgucucagaucgagcucgcuguucugcuuuccaaugaagguaucauuaacucagaggacgaacaccuguuggcgcucgagcggaaacugaagaaaauguuagggcccagugcaguggauaucggcaauggauguuucgagacuaagcacaagugcaaccagacgugccuggaccguauugccgcuggcacauuuaaugccggggaguucagccuaccaaccuuugauucccucaacauaacugcagccucucugaaugacgauggacuugacaaccauaccaucuugcuguauuacagcacagcugccucaagucucgcagucacccugaugcuugcgauuuucaucguguauauggucucccgcgacaaugugagcuguucuaucugccuguga

SEQ ID NO: 149852 - RNA, 1755 nt, Artificial Sequence; identical to SEQ ID NO: 149781
  derived and/or modified sequence opt3 from hemagglutinin__InfluenzaB__AGZ60217

SEQ ID NO: 149853 - RNA, 1755 nt, Artificial Sequence
  derived and/or modified sequence opt3 from hemagglutinin__InfluenzaB__AGZ60268
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcccggcaaaacaggcacuauaguauaucagcgcgggguguuacugccucagaaggucuggugcgccucuggacgguccaaagugauuaaggguucacuuccauugaucggcgaagcugauugucugcaugagaaauacgggggacuaaacaagagcaaacccuacuauaccggcgaacacgccaaggcaauugguaauugcccgaucuggguuaagacaccucucaaacuggcuaacgggacuaaguacaggcccccagccaaacuucugaaggagcgaggcuuuuucggagcgaucgccggcuuuuuggaagggggaugggaagguaugauugcaggcuggcacggguauaccagucauggagcucacggcguggccgucgcugccgaccucaaaucuacacaggaggcaauaaauaagaucaccaagaacuuaaauucccugagcgaacuggaggugaaaaaccuccaaagacuuucgggugccauggacgaacugcauaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccuagcgccaucgacauuggaaacggcuguuucgagacgaagcacaagugcaaucagacaugccuggaucguaucgcugccgggaccuuuaacgcaggagaguucucccuacccacuuuugacucucucaauauuaccgccgcuagccugaacgaugacggucuugauaaucauacaauauugcuguacuauucaaccgccgcaaguucccucgcggugacucugaugcuugcuaucuucauugucuacauggugagccgcgacaacgucucuuguucaaucugccuguga

SEQ ID NO: 149854 - RNA, 1755 nt, Artificial Sequence; identical to SEQ ID NO: 148870
  derived and/or modified sequence opt3 from hemagglutinin__InfluenzaB__AHE37993

SEQ ID NO: 149855 - RNA, 1755 nt, Artificial Sequence; identical to SEQ ID NO: 148915
  derived and/or modified sequence opt3 from hemagglutinin__InfluenzaB__AHE37994

SEQ ID NO: 149856 - RNA, 1755 nt, Artificial Sequence; identical to SEQ ID NO: 148870
  derived and/or modified sequence opt3 from hemagglutinin__InfluenzaB__AHE37995

SEQ ID NO: 149857 - RNA, 1755 nt, Artificial Sequence; identical to SEQ ID NO: 148870
  derived and/or modified sequence opt3 from hemagglutinin__InfluenzaB__AHE37996

SEQ ID NO: 149858 - RNA, 1755 nt, Artificial Sequence; identical to SEQ ID NO: 148915
  derived and/or modified sequence opt3 from hemagglutinin__InfluenzaB__AHE37997

SEQ ID NO: 149859 - RNA, 1755 nt, Artificial Sequence; identical to SEQ ID NO: 148915
  derived and/or modified sequence opt3 from hemagglutinin__InfluenzaB__AHE37998

SEQ ID NO: 149860 - RNA, 1755 nt, Artificial Sequence; identical to SEQ ID NO: 148915
  derived and/or modified sequence opt3 from hemagglutinin__InfluenzaB__AHE37999

SEQ ID NO: 149861 - RNA, 1755 nt, Artificial Sequence; identical to SEQ ID NO: 148870
  derived and/or modified sequence opt3 from hemagglutinin__InfluenzaB__AHE38000

SEQ ID NO: 149862 - RNA, 1755 nt, Artificial Sequence; identical to SEQ ID NO: 148870
  derived and/or modified sequence opt3 from hemagglutinin__InfluenzaB__AHE38001

SEQ ID NO: 149863 - RNA, 1755 nt, Artificial Sequence
  derived and/or modified sequence opt3 from hemagglutinin__InfluenzaB__AHE38002
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccaaaaaggcuccugggggaccauaccggcucggcaccucaggcagcugccccaacgcaacaaguaaauccggguucuuugccaccauggcuugggccguuccuaaggacaauaacaaaaaugcgacgaacccacugacuguggaagucccguauauuugugcagagggagaagaucagaucacagugugggguuuccauucugacaauaagacccagaugaagaaccuguacggcgauagcaauccccaaaaauuuacuuccucagccaacggggugacaacccacuaugucagucagauuggaggcuucccugaccagacggaggauggugggcucccacagagcggacgcaucguuguggacuacaugaugcaaaagcccggcaaaaccggcacaauaguauaucagagagggguguuacugccucagaaggucuggugcgcuucuggaagguccaaagugauuaaggguucacuuccauugaucggcgaggccgauugucugcaugaaaaauacgggggacuaaacaagagcaagcccuacuauacuggcgagcacgcaaaagcuauugguaauugcccgaucuggguuaagaccccucucaaacuggccaacgggacaaaguaccggcccccagcgaaacuucugaaggaacgcggcuuuuucggagccaucgcaggcuuuuuggaagggggaugggaggguaugauugcuggcuggcacggguauacuucccauggagcccacggcguggcugucgccgcagaccucaagucuacccaggaggccauaaauaaaaucacaaagaaccugaauaguuuaagcgagcuggaagugaaaaaccuccaacgacuuucgggugcuauggacgagcugcauaaugaaauuuuggagcuagaugagaagguagacgaucugagagcggacaccaucucuucccagauagaacucgcaguucugcuuucaaacgaggggauuaucaauagugaagaugagcaccuguuggcccucgaaaggaaacugaagaagauguuaggcccuagcgcuguggacaucggaaacggcuguuucgagacuaaacacaagugcaaucagacgugccuggaucggauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgugacaacgugucuuguucaauuugccuguga

SEQ ID NO: 149864 - RNA, 1755 nt, Artificial Sequence; identical to SEQ ID NO: 148870
  derived and/or modified sequence opt3 from hemagglutinin__InfluenzaB__AHE38003

SEQ ID NO: 149865 - RNA, 1755 nt, Artificial Sequence; identical to SEQ ID NO: 148870
  derived and/or modified sequence opt3 from hemagglutinin__InfluenzaB__AHE38004

SEQ ID NO: 149866 - RNA, 1755 nt, Artificial Sequence; identical to SEQ ID NO: 148870
  derived and/or modified sequence opt3 from hemagglutinin__InfluenzaB__AHE38005

SEQ ID NO: 149867 - RNA, 1755 nt, Artificial Sequence
  derived and/or modified sequence opt3 from hemagglutinin__InfluenzaB__AHE38006
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggagcuacgccuagcgccaaggcauccauccuccaugaaguccgcccagugacuucuggcuguuuucccauuaugcacgaccgaaccaagauccgucaacuggccaaucuucugagagguuaugagaacauaagguugucgacacagaauguaaucgaugcugaaaaagcaccugggggaccauaccggcucggcacuucaggcagcugccccaacgccaccaguaaguccggguucuuugcuacaauggccugggcgguuccuaaagacaauaacaagaaugcaaccaacccacugacgguggaggucccguauauuugugccgaaggagaggaucagaucacugugugggguuuccauucugacaauaaaacacagaugaagaaccuguacggcgauagcaauccccaaaaguuuaccuccucagcuaacggggugacuacacacuaugucagucagauuggaggcuucccugaccagaccgaggauggugggcucccacagagcggacgcaucguuguggacuacaugaugcaaaaacccggcaagacgggcaccauaguauaucagagagggguguuacugccucagaaagucuggugcgccucuggaagguccaaggugauuaaagguucacuuccauugaucggcgaagcagauugucugcaugagaaguacgggggacuaaacaaaagcaagcccuacuauacaggcgaacacgcuaaggccauugguaauugcccgaucuggguuaaaacuccucucaagcuggcgaacgggaccaaauaccggcccccagccaagcugcugaaagagcgcggcuuuuucggagcaaucgcuggcuuuuuggaagggggaugggaagguaugauugccggcuggcacggguauacaagucauggagcucacggcguggccgucgcagccgaccucaagucuacucaggaggcuauaaauaagaucaccaaaaaccuuaauuccuuaagcgaacuggaggugaagaaccuccaacgacuuucgggugcgguagacgaacugcauaaugagauuuuggagcuagaugaaaaaguugacgaucugagagcagacacaaucucuucccagauagagcucgccgugcugcuuucaaacgaagggauuaucaauagugaggaugaacaccuguuggcucucgagaggaagcugaaaaagauguuaggcccuagcgccgucgacaucggaaacggcuguuucgagaccaagcacaaaugcaaucagacuugccuggaucggauugcagccgggacguuuaacgcuggagaguucucccuacccacauuugacucucucaauaucaccgccgcaagccugaacgaugacggucuugauaaucauacuauuuugcuguacuauucaaccgcggcuaguucccucgccgugacacugaugcuugcaauauucaucgucuacauggugagccgugacaacguuucuuguucaauuugccuguga

SEQ ID NO: 149868 - RNA, 1755 nt, Artificial Sequence; identical to SEQ ID NO: 148870
  derived and/or modified sequence opt3 from hemagglutinin__InfluenzaB__AHE38007

SEQ ID NO: 149869 - RNA, 1755 nt, Artificial Sequence
  derived and/or modified sequence opt3 from hemagglutinin__InfluenzaB__AHE38008
augaaggccaucauugcucugcucaugguggucaccagcaacgcagacagaauaugcacaggcaucacuuccucuaauucaccccacguugugaaaacggccacccagggggagguaaacgugacaggagucauuccucuuacuaccacaccaaccaagaguuacuucgcgaaucugaaagguacuaagacaaggggcaaauuguguccggauugcuuaaacuguaccgaccuggauguggcucuagggcggcccaugugcguuggaacgacuccuagcgccaaggcauccauccuccaugaagugcgcccagucaccucuggcuguuuucccauuaugcacgaccgaacaaagauccgucaacuggccaaucuucugagagguuaugagaacauaagguugucgacucagaaugugaucgaugcugaaaaagcaccugggggaccauaccggcucggcaccucaggcagcugccccaacgccacaaguaaguccggguucuuugcuaccauggccugggcgguaccuaaagacaauaacaagaaugcaacgaacccacugacuguugaggugccguauauuugugccgaaggagaggaucagaucgcugucugggguuuccauucugacaauaaaacacagaugaagaaccuguacggcgauagcaauccccaaaaguuuaccuccucagccaacggggugacuacacacuaugugagucagauuggaggcuucccugaccagaccgaggauggugggcucccacagagcggacgcaucgucguugacuacaugaugcaaaaacccggcaagacgggcaccauaguguaucagagagggguauuacugccucagaaaguguggugcgcaucuggaagguccaaggucauuaaagguucacuuccauugaucggcgaagcugauugucugcaugagaaguacgggggacuaaacaaaagcaagcccuacuauacaggcgaacacgccaaggcgauugguaauugcccgaucugggugaaaacuccucucaagcuggccaacgggaccaaauaccggcccccagcaaagcugcugaaagagcgcggcuuuuucggagcuaucgccggcuuuuuggaagggggaugggaagguaugauugcuggcuggcacggguauacaagucauggagcccacggcguugcaguggccgcugaccucaagucuacucaggaggcgauaaauaagaucaccaaaaaccuuaauuccuuaagcgaacuggaggucaagaaccuccaacgacuuucgggugcaauggacgaacugcauaaugagauuuuggagcuagaugaaaaaguggacgaucugagagccgacacaaucucuucccagauagagcucgcuguacugcuuucaaacgaagggauuaucaauagugaggaugaacaccuguuggcccucgagaggaagcugaaaaagauguuaggcccuagcgcaguugacaucggaaacggcuguuucgagaccaagcacaaaugcaaucagacuugccuggaucggauugccgcugggacguuuaacgccggagaguucucccuacccacauuugacucucucaauaucaccgcagcgagccugaacgaugacggucuugauaaucauacuauuuugcuguacuauucaaccgcugccaguucccucgcagugacacugaugcuugccauauucaucgucuacauggugagccgugacaacgucucuuguucaauuugccuguga

SEQ ID NO: 149870 - RNA, 1755 nt, Artificial Sequence; identical to SEQ ID NO: 148915
  derived and/or modified sequence opt3 from hemagglutinin__InfluenzaB__AHE38009

SEQ ID NO: 149871 - RNA, 1755 nt, Artificial Sequence; identical to SEQ ID NO: 148915
  derived and/or modified sequence opt3 from hemagglutinin__InfluenzaB__AHE38010

SEQ ID NO: 149872 - RNA, 1755 nt, Artificial Sequence; identical to SEQ ID NO: 148870
  derived and/or modified sequence opt3 from hemagglutinin__InfluenzaB__AHE38012

SEQ ID NO: 149873 - RNA, 1755 nt, Artificial Sequence
  derived and/or modified sequence opt3 from hemagglutinin__InfluenzaB__AHE38013
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgugucuggaagguccaagguuauuaaagguucacuuccauugaucggcgaagcugauugucugcaugagaaguacgggggacuaaacaaaagcaagcccuacuauacuggcgaacacgccaaggcaauugguaauugcccgaucugggugaaaaccccucucaagcuggcuaacgggacaaaauaccggcccccagccaagcugcugaaagagcgcggcuuuuucggagcgaucgccggcuuuuuggaagggggaugggaagguaugauugcaggcuggcacggguauacaagucauggagcucacggcauggccgucgcugccgaccucaagucuacccaggaggcaauaaauaagaucacuaaaaaccuuaauuccuuaagcgaacuggaggugaagaaccuccaacgacuuucgggugccauggacgaacugcauaaugagauuuuggagcuagaugaaaaaguagacgaucugagagcugacaccaucucuucccagauagagcucgcgguucugcuuucaaacgaagggauuaucaauagugaggaugaacaccuguuggcacucgagaggaagcugaaaaagauguuaggcccuagcgccguggacaucggaaacggcuguuucgagacuaagcacaaaugcaaucagacgugccuggaucggauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggucacccugaugcuugcuauauucaucguguacauggucagccgugacaacgugucuuguucaauuugccuguga

SEQ ID NO: 149874 - RNA, 1755 nt, Artificial Sequence; identical to SEQ ID NO: 148870
  derived and/or modified sequence opt3 from hemagglutinin__InfluenzaB__AHE38014

SEQ ID NO: 149875 - RNA, 1758 nt, Artificial Sequence; identical to SEQ ID NO: 148661
  derived and/or modified sequence opt3 from hemagglutinin__InfluenzaB__AHE38015

SEQ ID NO: 149876 - RNA, 1758 nt, Artificial Sequence
  derived and/or modified sequence opt3 from hemagglutinin__InfluenzaB__AHE38016
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaaaucuaaggucaucaaaggcucccugccacuuauuggggaagcagacuguuugcaugagaaguauggaggccugaauaagucaaaacccuacuacacaggugagcacgccaaggcuauagggaacugcccgaucugggugaaaacuccucuaaagcucgccaauggcaccaaauauaggcccccagcaaagcugcuuaaggaacggggauuuuucggcgcuauugccggguuucuggagggagguugggaaggcaugaucgcgggguggcauggauacacaagccacggcgcccacgguguugcaguggcugccgauuugaaaaguacccaggaggcuauaaacaagauuacuaaaaaucucaacucucuguccgaauuagaggucaagaaucugcagcgccucagcggggccauggacgagcuucauaacgaaauccuggaguuggaugaaaaaguggacgaccuacgagcagauacgaucucgucucaaauugagcuggccguacuccuguccaaugaaggcaucauuaacucagaggacgagcaccuucuggcuuuggaaagaaagcucaagaaaaugcugggaccuagugcgguugagauaggcaauggguguuucgaaacaaagcauaaaugcaaccagaccugcuuagauaggaucgcagccggaacuuuugacgcuggugaguucagccugcccaccuuugauucccuaaauauuacagccgcaucucucaacgacgauggccuggacaaucacaucauccuuuuguauuacagcaccgccgcuucaagucuggccgugacucucaugauugcaauauucgucguguauauggucucccgggauaacgugagcuguucuaucugccuguga

SEQ ID NO: 149877 - RNA, 1758 nt, Artificial Sequence; identical to SEQ ID NO: 148980
  derived and/or modified sequence opt3 from hemagglutinin__InfluenzaB__AHE38017

SEQ ID NO: 149878 - RNA, 1758 nt, Artificial Sequence; identical to SEQ ID NO: 148903
  derived and/or modified sequence opt3 from hemagglutinin__InfluenzaB__AHE38018

SEQ ID NO: 149879 - RNA, 1758 nt, Artificial Sequence; identical to SEQ ID NO: 148888
  derived and/or modified sequence opt3 from hemagglutinin__InfluenzaB__AHE38019

SEQ ID NO: 149880 - RNA, 1758 nt, Artificial Sequence
  derived and/or modified sequence opt3 from hemagglutinin__InfluenzaB__AHE38020
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaucaccccaacaaagagucauuucgccaaucugaaagguaccgaaacuaggggcaaguuguguccgaaaugcuuaaacuguacagaucuggacguugcgcuagggcggcccaagugcaccggaaagauuccuagcgcucgcguguccauccuccacgagguccgaccagugacgucuggcuguuuucccauaaugcaugaucguacuaaaaucagacaacugccuaaucuucugagggguuacgaacacauucgguugucgacccauaacguaaucaaugccgaggacgcaccagggggacccuauaagauuggcacaucaggcagcugcccuaacguuacuaaugggaacggauucuuugccaccauggcuugggcagugccgaaaaaugauaagaacaaaacagccaccaauccacucacgaucgaaguccccuacauauguacugagggugaggaccagauuacaguguggggcuuccacagugauaacgaaacccagauggcuaagcuguauggggacuccaagccucagaaauuuacuucuagcgccaauggagugacaacccacuacgucucccaaaucggcgguuucccaaaccagacggaggaugggggacugccccagucaggccgcauuguuguggacuauaugguacagaagaguggcaaaaccgggacaaucacuuaccaaagaggaauccucuuaccucagaagguguggugcgcgagcgguaggucuaaagucauuaagggcucccugccacuuauaggggaagcagauuguuugcaugagaaauauggaggccugaacaagucaaagcccuacuacaccggugagcacgccaaagcuaucgggaauugcccgauuugggugaagacaccucuaaaacucgccaacggcacuaaguaucggcccccagcaaaacugcuuaaggaacgcggauuuuucggcgcuaucgccggguuucuggagggagguugggaaggcaugauagcgggguggcauggauacaccagccacggcgcccacgguguugcaguggcugccgacuugaagaguacacaggaggcuauuaauaaaaucaccaagaaccucaauucucuguccgaauuagaggucaaaaaccugcagcgacucagcggggccauggaugagcuucauaaugaaauccuggaguuggacgaaaagguggacgaucuaagagcagacacuauuucgucucaaaucgagcuggccguacuccuguccaacgaaggcauuauaaauucagaggaugagcaccuucuggcuuuggaaaggaaacucaagaagaugcugggaccuagugcgguugagaucggcaacggguguuucgaaacgaaacauaagugcaaucagacaugcuuagaccggauugcagccggaaccuuugaugcuggugaguucagccugcccacuuuugacucccuaaacaucaccgccgcaucucucaaugaugacggccuggauaaccacacaauccuuuuguauuacagcaccgccgcuucaagucuggccgugacucucaugauugcaauauucgucguguauauggucucccgugacaaugugagcuguucuaucugccuguga

SEQ ID NO: 149881 - RNA, 1758 nt, Artificial Sequence
  derived and/or modified sequence opt3 from hemagglutinin__InfluenzaB__AHE38021
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaacccucagaaguuuacaucuagcgccaacggagugaccacgcacuacgucucccaaauuggcgguuucccaaaucagaccgaggacgggggacugccccagucaggccgcaucguuguggauuauaugguacagaaaaguggcaagacagggacuauuaccuaccaaagaggaauccucuuaccucagaaaguguggugcgcgagcgguaggucuaaggucaucaaaggcucccugccacuuauuggggaagcagacuguuugcaugagaaguauggaggccugaacaaaucaaagcccuacuacacaggugagcacgccaaggcuauagggaauugcccgaucugggugaaaacuccucuaaagcucgccaacggcaccaaauaucggcccccagcaaagcugcuuaaagaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaauaagauuacuaaaaaccucaauucucuguccgaauuagaggucaagaaccugcagcgacucagcggggccauggacgagcuucauaaugaaauccuggaguuggaugaaaaaguggacgaccuaagagcagauacgaucucgucucaaauugagcuggccguacuccuguccaacgaaggcaucauuaauucagaggacgagcaccuucuggcuuuggaaaggaagcucaaaaagaugcugggaccuagugcgguugagauaggcaacggguguuucgaaacaaagcauaaaugcaaucagaccugcuuagaucggaucgcagccggaacuuuugacgcuggugaguucagccugcccaccuuugauucccuaaacauuacagccgcaucucucaaugacgauggccuggacaaccacaccauccuuuuguauuacagcacugccgcuucaagucuggccgugacacucaugaucgcaauuuucgucguguauauggucucccgugauaacgugagcuguucuauaugccuguga

SEQ ID NO: 149882 - RNA, 1758 nt, Artificial Sequence; identical to SEQ ID NO: 148903
  derived and/or modified sequence opt3 from hemagglutinin__InfluenzaB__AHE38022

SEQ ID NO: 149883 - RNA, 1752 nt, Artificial Sequence
  derived and/or modified sequence opt3 from hemagglutinin__InfluenzaB__AHL91189
augaaggccaucauugugcugcucauggucgcuaccagcaacgcagacagaauaugcacaggcaucacuuccucuaauucaccccacguugugaaaacggccacccagggggagguaaacgugacaggagucauuagucuuacuaccacaccuaccaagagccauuucgcgaaucugaaagguacuaagacaaggggcaaauuguguccaaacugcuuaaauuguaccgaucuggacguggcucuagggcggccgaucugcauuggaacgauccccuccgccaaggcaucuauacuccacgaaguucgcccugugacuucgggcuguuuuccaaucaugcaugaucgaaccaagauucgucaacugcccaaccuucugagagguuacgagcacaucagguugucaacacauaaugucauuaacgccgaacgggcuccugggggaccauaucgccucggcacuagcggcaguugccccaaugugaccuccagaucuggguucuuugcaacaauggccugggcuguaccuagggacaacaaaaccgccacgaauccacugacuguugaggugccguacaucuguacaaagggagaagaucagauaaccgucugggguuuccacagcgacaacaaaacucagaugaagaaucuguauggcgauuccaacccccagaaauuuacaucaagugcgaauggggugaccacgcacuacgugagccaaauuggaggcuucccuaaccagaccgaggacggugggcucccacagucuggacggaucgucguugauuauauggugcagaagcccggcaagacaggcacuauuguauaccaacgcgggguguuacugccucagaaagucuggugcgcauccggacgaucaaaggugaucaaagguagccuuccauugaucggcgaggccgacugucugcaugaaaaguaugggggacuaaacaaaaguaagcccuacuacaccggcgagcacgcuaaagccauugguaauugcccgauauggguuaagacaccucucaagcuggcaaacgggacuaaauauagacccccagcuaaacuucugaaggaaaggggcuuuuucggagccaucgcgggcuuuuuggaagggggaugggaggguaugauugccggcuggcauggguacaccucucacggagcacacggcguggcugucgccgcugaucucaaguccacacaggaggccaucaauaaaauaaccaagaaccugaauagcuuaucggagcuggaagugaagaaccuccagcggcuuucuggugcaauggacgagcugcauaaugaaauuuuggagcuagaugagaaaguagacgaccugcgugccgauacuaucuccucacaaaucgaacucgcuguucugcuuaguaacgaggggauuaucaauagcgaagacgagcaccuguuggcgcucgaacgcaagcugaaaaagauguuaggcccuuccgcaguggauauuggaaacggcuguuucgagacgaaacauaagugcaaucagacaugccuggacagaauagccgcugggaccuuuaacgccggagaguucucucuacccacuuuugauagccucaauaucaccgcagccucacugaacgacgauggucuugacaaucacacaauuuugcuguauuacaguaccgcugccuccagccucgcagucacucugaugaucgcgaucuucauuguguauauggucucuagggauaacgugucauguaguauaugccuuuga

SEQ ID NO: 149884 - RNA, 1752 nt, Artificial Sequence
  derived and/or modified sequence opt3 from hemagglutinin__InfluenzaB__AHL91200
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaacgauuccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacaacaaaacucagaugaagaaucuguauggcgauagcaacccucagaaauuuacauccucagccaauggggugaccacgcacuacgucagucaaauaggagacuucccaaaccagaccgaggauggcggucucccccagagcgggcggauuguuguggacuauaugguacagaagccuggaaagacaggcacuaucguguaccaacgcggcgucuuacugccacagaaaguguggugcgcgucugggcgauccaagguuauuaaaggaucacuucccuugaucggugaggcagauugucugcaugaaaaguauggcgggcuaaacaaaagcaagccguacuacaccggagagcacgccaaagcuaucggcaauugcccuauuugggugaagacaccccucaagcuggccaacgguacuaaauauagaccuccagcaaagcugcugaaagaaaggggguuuuucggcgcuauagccggauuuuuggagggcgggugggagggaaugaucgcggguuggcauggcuacaccagucacggggcccacggagucgcaguggcugccgaccucaagucuacacaggaagcuauuaauaaaaucaccaagaaccuuaauuccuuaagcgagcuggaaguaaagaaccuccagcggcuuucgggcgccauggaugagcugcauaaugaaauauuggagcuagacgagaaaguugacgaucugcgugcagacacuauuucuucccaaaucgaacucgccgugcugcuuucaaacgaggguaucauuaauagugaagaugagcaccuguuggcucucgaacgcaagcugaaaaagauguuagggcccagcgcggucgacaucggcaacggauguuucgagacgaaacauaagugcaaucagacaugccuggauagaauugcagccggcaccuuuaacgcuggggaguucucccuaccaacuuuugacucucucaauauaaccgccgcaagccugaacgaugacggacuugauaaucacacaaucuugcuguauuacucaaccgccgcuaguucccucgccgugacucugaugauugcaaucuucaucgucuauauggugagcagggacaacguuucuuguucaauuugccuuuga

SEQ ID NO: 149885 - RNA, 1752 nt, Artificial Sequence
  derived and/or modified sequence opt3 from hemagglutinin__InfluenzaB__AHL91211
augaaggccaucauugugcugcucauggucgcuaccagcaacgcagacagaauaugcacaggcaucacuuccucuaauucaccccacguugugaaaacggccacccagggggagguaaacgugacaggagucauuagucuuacuaccacaccuaccaagagccauuucgcgaaucugaaagguacuaagacaaggggcaaauuguguccaaacugcuuaaauuguaccgaucuggacguggcucuagggcggccgaugugcaucggaacgauucccuccgccaaggcaucuauccuccacgaaguucgcccugugacuucgggcuguuuuccaauaaugcaugaucgaaccaagauccgucaacugcccaaccuucugagagguuacgagcacauuagguugucaacacauaaugucaucaacgccgaacgggcuccugggggaccauaucgccucggcacuagcggcaguugccccaaugugaccuccagaucuggguucuuugcaacaauggccugggcuguaccuagggacaacaaaaccgccacgaauccacugacuguugaggugccguacauuuguacaaagggagaagaucagaucaccgucugggguuuccacagcgacaacaaaacucagaugaagaaucuguauggcgauuccaacccccagaaauuuacaucaagugcgaauggggugaccacgcacuacgugagccaaauaggaggcuucccuaaccagaccgaggacggugggcucccacagucuggacggauugucguugauuauauggugcagaagcccggcaagacaggcacuaucguauaccaacgcgggguguuacugccucagaaagucuggugcgcauccggacgaucaaaggugauuaaagguagccuuccauugaucggcgaggccgacugucugcaugaaaaguaugggggacuaaacaaaaguaagcccuacuacaccggcgagcacgcuaaagccaucgguaauugcccgauuuggguuaagacaccucucaagcuggcaaacgggacuaaauauagacccccagcuaaacuucugaaggaaaggggcuuuuucggagccauagcgggcuuuuuggaagggggaugggaggguaugaucgccggcuggcauggguacaccucucacggagcacacggcguggcugucgccgcugaucucaaguccacacaggaggccauuaauaaaaucaccaagaaccugaauagcuuaucggagcuggaagugaagaaccuccagcggcuuucuggugcaauggacgagcugcauaaugaaauauuggagcuagaugagaaaguagacgaccugcgugccgauacuauuuccucacaaaucgaacucgcuguucugcuuaguaacgaggggaucauuaauagcgaagacgagcaccuguuggcgcucgaacgcaagcugaaaaagauguuaggcccuuccgcaguggauaucggaaacggcuguuucgagacgaaacauaagugcaaucagacaugccuggacagaauugccgcugggaccuuuaacgccggagaguucucucuacccacuuuugauagccucaauauaaccgcagccucacugaacgacgauggucuugacaaucacacaaucuugcuguauuacaguaccgcugccuccagccucgcagucacucugaugauugcgaucuucaucguguauauggucucuagggauaacgugucauguaguauuugccuuuga

SEQ ID NO: 149886 - RNA, 1755 nt, Artificial Sequence
  derived and/or modified sequence opt3 from hemagglutinin__InfluenzaB__AHL91222
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcgugggaacgacuccuagcgcuaaggccuccauccuccacgaaguccgcccagugaccucuggcuguuuucccauuaugcaugaucgaacaaagauccgucaacugccuaaccuucugagagguuacgagaauauaagguugucgacucagaacguaaucaaugcagaaaaagccccagggggacccuaucggcucggcaccucaggcagcugcccuaacgcuacaagucgcuccggguucuuugcaaccauggccugggcuguuccaagagacaauaacaagacggccacuaauccgcugacaguggagguccccuacguguguaccgaaggagaggaucagauuacugugugggguuuccacucugacaacaaaacacagaugaagaaucuguauggcgauagcaacccucaaaaauuuaccuccucagcgaacggggucacgacccauuacguuagucagaucggaggcuucccagaccagacagaggauggugggcucccccagagcggaaggauugugguagacuauauggugcaaaagccuggcaagacuggcaccaucgucuaccagcgcgggguguuacugccacagaaaguuuggugcgcaucuggacgguccaaggugauaaaagguucacuucccuugauuggcgaagccgauugucugcacgagaaguaugggggacuaaauaaaagcaagccguacuacacaggcgaacacgcuaaagccaucgguaacugcccuauuugggucaagacuccccucaagcuggcaaaugggaccaaauaucgaccuccagcuaaacuucugaaggagagaggcuuuuucggagccaucgcgggcuuuuuggaagggggaugggaagguaugaucgccggcuggcauggguacacaagucacggagcacauggcguggcuguagccgcugaccucaagucuacccaggaggccauuaacaaaauaacuaagaaucugaacuccuuaagcgaacuggagguuaagaaucuccaaaggcuuucgggugcaauggaugaacugcacaacgagaucuuggagcuagacgaaaaaguggacgaucugcgggccgacacgauuucuucccagaucgagcucgcuguccugcuuucaaaugaagggauaauuaacagugaggaugaacaccuguuggcgcucgagcguaagcugaaaaagauguuaggccccagcgcaguggacaucggaaauggcuguuucgagacaaaacauaagugcaaccagaccugccuggaucgcaucgccgcugggacuuuuaaugccggagaguucucccuaccaaccuuugacucucucaacauuacagcagccagccugaaugaugacggucuugauaaccacaccaucuugcuguauuacucaacugcugccaguucccucgcagucacacugaugauugcgauauucaucguguauaugguuagcagagacaacauuucuuguucaaucugccuuuga

SEQ ID NO: 149887 - RNA, 1755 nt, Artificial Sequence
  derived and/or modified sequence opt3 from hemagglutinin__InfluenzaB__AHL91244
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaacuaccccuagcgcuaaggccuccauccuccacgaaguccgcccagugacaucuggcuguuuucccauuaugcaugaucgaacuaagauccgucaacugccuaaucuucugagagguuacgagaaaauaagguugucgacccagaacguaaucaaugcagaaaaggccccagggggacccuaucggcucggcacaucaggcagcugcccuaacgcuaccagucgcuccggguucuuugcaacgauggccugggcuguuccaagagacaauaacaaaacugccacaaauccgcugaccguggagguccccuacauuuguacuaaggaagaggaucagaucacaguguggggauuccacucugacaacaaaacccagaugaagaaucuguauggugauagcaacccucaaaaguuuacguccucagcgaauggcgugaccacacauuacgucagucagauugggggauucccagaccagacugaggauggcggucucccccagagcgggaggaucguuguggacuauaugguacaaaaaccuggaaagaccggcacaauaguguaccagcggggcgucuuacugccacagaaaguguggugcgcaucugggcgcuccaagguuauuaaaggaucacuucccuugaucggugaagccgauugucugcacgagaaguauggcgggcuaaacaaaagcaagccguacuacacuggagaacacgcuaaggccauuggcaacugcccuaucugggugaaaaccccacucaagcuggcaaaugguacaaaauaucgacccccugcuaaacuucugaaggagagaggguuuuucggcgccaucgcgggauuuuuggagggcgggugggaaggaaugauugccgguuggcauggcuacaccagucacggggcacauggagucgcuguggccgcugaccucaagucuacucaggaggccauaaacaagaucacgaaaaaucugaacuccuuaagcgaacuggagguaaagaaucuccaaaggcuuucgggcgcaauggaugaacugcacaacgagauuuuggagcuagacgaaaaaguugacgaucugcgggccgacacaaucucuucccagauagagcucgcugugcugcuuucaaaugaagguauuaucaacagugaggaugaacaccuguuggcgcucgagcguaagcugaaaaagauguuagggcccagcgcagucgacaucggcaauggauguuucgagaccaagcauaaaugcaaccagacuugccuggaucgcauugccgcuggcaccuuuaaugccggggaguucucccuaccaacauuugacucucucaacaucaccgcagccagccugaaugaugacggacuugauaaccacacuauuuugcuguauuacucaacagcugccaguucccucgcagugacgcugaugauagcgaucuucauugucuauauggugagcagagacaauguuucuuguucaaucugccuuuga

SEQ ID NO: 149888 - RNA, 1755 nt, Artificial Sequence; identical to SEQ ID NO: 148517
  derived and/or modified sequence opt3 from hemagglutinin__InfluenzaB__AHL91255

SEQ ID NO: 149889 - RNA, 1755 nt, Artificial Sequence; identical to SEQ ID NO: 148517
  derived and/or modified sequence opt3 from hemagglutinin__InfluenzaB__AHL91266

SEQ ID NO: 149890 - RNA, 1752 nt, Artificial Sequence
  derived and/or modified sequence opt3 from hemagglutinin__InfluenzaB__AHL91277
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaacugcuuaaauuguaccgaucuggacguugcgcuagggcggcccaugugcaucggaauuacgccuagcgcuaaggccuccauccuccacgaagugcgcccagucacuucuggcuguuuucccauaaugcaugaucgaaccaagauccgucaacugccuaaccuucugagagguuacgagcacauuagguugucgacacauaaugugaucaacgcagaacgggccccagggggacccuaucgccucggcacuucaggcagcugcccuaauguaaccaguagauccggguucuuugcuacaauggcaugggccguuccaagggacaacaaaaccgcuacgaauccgcugacuguggagguccccuacauuuguacaaagggagaagaucagaucaccgugugggguuuccacucugacaacaaaacucagaugaagaaucuguauggcgauagcaacccucagaaauuuacauccucagccaaugggauaaccacgcacuacgugagucaaauuggaggcuucccaaaccagaccgaggacggugggcucccccagagcggacggaucgucguugauuauauggugcagaagccuggcaagacaggcacuauuguauaccaacgcgggguguuacugccacagaaagucuggugcgcgucuggacgauccaaggugaucaaagguucacuucccuugaucggcgaggcagacugucugcaugaaaaguaugggggacuaaacaaaagcaagccguacuacaccggcgagcacgccaaagcuauugguaauugcccuauauggguuaagacaccccucaagcuggccaacgggacuaaauauagaccuccagcaaagcugcugaaagaaaggggcuuuuucggagcuaucgccggcuuuuuggaagggggaugggaggguaugauugcgggcuggcauggguacaccagucacggagcccacggcguggcagucgcugccgaucucaagucuacacaggaggcuaucaauaaaauaaccaagaaccuuaauuccuuaagcgagcuggaagugaagaaccuccagcggcuuucgggugccauggacgagcugcauaaugaaauuuuggagcuagaugagaaaguagacgaccugcgugcagauacuaucucuucccaaaucgaacucgccguucugcuuucaaacgaggggauuaucaauagugaagacgagcaccuguuggcucucgaacgcaagcugaaaaagauguuaggccccagcgcgguggauauuggaaacggcuguuucgagacgaaacauaagugcaaucagacaugccuggacagaauagcagccgggaccuuuaacgcuggagaguucucccuaccaacuuuugauucucucaauaucaccgccgcaagccugaacgacgauggucuugacaaucacacaauuuugcuguauuacucaaccgccgcuaguucccucgccgucacucugaugaucgcaaucuucauuguguauauggucagcagggauaacgugucuuguucaauaugccuuuga

SEQ ID NO: 149891 - RNA, 1755 nt, Artificial Sequence
  derived and/or modified sequence opt3 from hemagglutinin__InfluenzaB__AHL91299
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaggagucauuucgccaaucugaaggguacuaaaacacggggcaaguuguguccgaccugcuuaaacuguacggaucuggacguugcgcuagggcgccccaugugcgugggaacuaccccuagcgcuaaagccuccauccuccacgaaguccgaccagugacaucuggcuguuuucccauuaugcaugaucguacuaagaucagacaacugccuaaucuucugagggguuacgagaagauacgguugucgacccagaacguaaucaaugcagaaaaagccccagggggacccuaucgccucggcacaucaggcagcugcccuaacgcuaccaguagauccggguucuuugcaacgauggccugggcuguuccaagggacaauaacaagacugccacaaauccgcugaccguggagguccccuacauuuguacuaaagaagaggaucagaucacaguguggggauuccacucugacaacaagacccagaugaaaaaucuguauggugauagcaacccucaaaaguuuacguccucagcgaauggcgugaccacacauuacgucagucagauugggggauucccagaccagacugaggauggcggucucccccagagcgggcggaucguuguggacuauaugguacaaaagccuggaaaaaccggcacaauaguguaccagcgcggcauuuuacugccacagaaggucuggugcgcaucugggcgauccaaagugaucaagggaucacuucccuugauuggugaagccgauugucugcacgagaaauauggcgggcuaaacaagagcaaaccguacuacacuggagaacacgcuaaggccaucggcaacugcccuaucuggguuaagaccccacucaaacuggcaaaugguacaaaguauagacccccugcuaaacuucugaaggagaggggguuuuucggcgccauugcgggauuuuuggagggcgggugggaaggaaugauagccgguuggcauggcuacaccagucacggggcacauggaguggcugucgccgcugaccucaaaucuacucaggaggccaucaacaagauuacgaagaaucugaacuccuuaagcgaacuggaggugaaaaaucuccaacggcuuucgggcgcaauggaugaacugcacaacgagaucuuggagcuagacgaaaagguagacgaucugcgugccgacacaauaucuucccagauugagcucgcuguucugcuuucaaaugaagguaucaucaacagugaggaugaacaccuguuggcgcucgagcgcaaacugaagaaaauguuagggcccagcgcaguggacauuggcaauggauguuucgagaccaagcauaagugcaaccagacuugccuggauagaaucgccgcuggcaccuuuaaugccggggaguucucccuaccaacauuugacucucucaacauuaccgcagccagccugaaugaugacggacuugauaaccacacuauauugcuguauuacucaacagcugccaguucccucgcagucacgcugaugaucgcgauuuucaucguguauaugaucagcagggacaaugucucuuguucaauuugccuuuga

SEQ ID NO: 149892 - RNA, 1755 nt, Artificial Sequence
  derived and/or modified sequence opt3 from hemagglutinin__InfluenzaB__AHL91310
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaacuaccccuagcgcuaaggccuccauccuccacgaaguccgcccagugacaucuggcuguuuucccauuaugcaugaucgaacuaagauccgucaacugccuaaucuucugagagguuacgagaaaauaagguugucgacccagaacguaaucaaugcagaaaaggccccagggggacccuaucggcucggcacaucaggcagcugcccuaacgcuaccagucgcuccggguucuuugcaacgauggccugggcuguuccaagagacaauaacaaaacugccacaaauccgcugaccguggagguccccuacauuuguacuaaggaagaggaucagaucacaguguggggauuccacucugacaacaaaacccagaugaagaaucuguauggugauagcaacccucaaaaguuuacguccucagcgaauggcgugaccacacauuacgucagucagauugggggauucccagaccagacugaggauggcggucucccccagagcgggaggaucguuguggacuauaugguacaaaaaccuggaaagaccggcacaauaguguaccagcggggcauuuuacugccacagaaagucuggugcgcaucugggcgcuccaaggugaucaaaggaucacuucccuugauuggugaagccgauugucugcacgagaaguauggcgggcuaaacaaaagcaagccguacuacacuggagaacacgcuaaggccaucggcaacugcccuaucuggguuaaaaccccacucaagcuggcaaaugguacaaaauaucgacccccugcuaaacuucugaaggagagaggguuuuucggcgccauugcgggauuuuuggagggcgggugggaaggaaugauagccgguuggcauggcuacaccagucacggggcacauggaguggcugucgccgcugaccucaagucuacucaggaggccaucaacaagauuacgaaaaaucugaacuccuuaagcgaacuggaggugaagaaucuccaaaggcuuucgggcgcaauggaugaacugcacaacgagaucuuggagcuagacgaaaaaguagacgaucugcgggccgacacaauaucuucccagauugagcucgcuguucugcuuucaaaugaagguaucaucaacagugaggaugaacaccuguuggcgcucgagcguaagcugaaaaagauguuagggcccagcgcaguggacauuggcaauggauguuucgagaccaagcauaaaugcaaccagacuugccuggaucgcaucgccgcuggcaccuuuaaugccggggaguucucccuaccaacauuugacucucucaacauuaccgcagccagccugaaugaugacggacuugauaaccacacuauauugcuguauuacucaacagcugccaguucccucgcagucacgcugaugaucgcgauuuucaucguguauaugaucagcagagacaaugucucuuguucaauuugccuuuga

SEQ ID NO: 149893 - RNA, 1755 nt, Artificial Sequence
  derived and/or modified sequence opt3 from hemagglutinin__InfluenzaB__AHL91321
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaccugcuuaaacuguacggaucuggacguugcgcuagggcggcccaugugcgugggaacuaccccuagcgcuaaggccuccauccuccacgaaguccgcccagugacaucuggcuguuuucccauuaugcaugaucgaacuaagauccgucaacugccuaaucuucugagagguuacgagaaaauaagguugucgacccagaacguaaucaaugcagaaaaggccccagggggacccuaucggcucggcacaucaggcagcugcccuaacgcuaccagucgcuccggguucuuugcaacgauggccugggcuguuccaagagacaauaacaaaacugccacaaauccgcugaccguggagguccccuacauuuguacuaaggaagaggaucagaucacaguguggggauuccacucugacaacaaaacccagaugaagaaucuguauggugauagcaacccucaaaaguuuacguccucagcgaauggcgugaccacacauuacgucagucagauugggggauucccagaccagacugaggauggcggucucccccagagcgggaggaucguuguggacuauaugguacaaaaaccuggaaagaccggcacaauaguguaccagcggggcgucuuacugccacagaaaguguggugcgcaucugggcgcuccaagguuauuaaaggaucacuucccuugaucggugaagccgauugucugcacgagaaguauggcgggcuaaacaaaagcaagccguacuacacuggagaacacgcuaaggccauuggcaacugcccuaucugggugaaaaccccacucaagcuggcaaaugguacaaaauaucgacccccugcuaaacuucugaaagagaagggguuuuucggcgccaucgcgggauuuuuggagggcgggugggaaggaaugauugccgguuggcauggcuacaccagucacggggcacauggagucgcuguggccgcugaccucaagucuacucaggaggccauaaacaaaaucacgaagaaucugaacuccuuaagcgaacuggagguaaagaaucuccaaagacuuucgggcgcaauggaugaacugcacaacgagauuuuggagcuagacgaaaagguugacgaucugagggccgacacaaucucuucccagauagagcucgcugugcugcuuucaaaugaagguauuaucaacagugaggaugaacaccuguuggcgcucgagcggaaacugaagaagauguuagggcccagcgcagucgacaucggcaauggauguuucgagaccaaacauaagugcaaccagacuugccuggaucguauugccgcuggcaccuuuaaugccggggaguucucccuaccaacauuugacucucucaacaucaccgcagccagccugaaugaugacggacuugauaaccacacuauuuugcuguauuacucaacagcugccaguucccucgcagugacgcugaugauagcgaucuucauugucuauauggugagccgcgacaauguuucuuguucaaucugccuuuga

SEQ ID NO: 149894 - RNA, 1755 nt, Artificial Sequence; identical to SEQ ID NO: 149892
  derived and/or modified sequence opt3 from hemagglutinin__InfluenzaB__AHL91332

SEQ ID NO: 149895 - RNA, 1755 nt, Artificial Sequence; identical to SEQ ID NO: 149892
  derived and/or modified sequence opt3 from hemagglutinin__InfluenzaB__AHL91343

SEQ ID NO: 149896 - RNA, 1755 nt, Artificial Sequence; identical to SEQ ID NO: 149892
  derived and/or modified sequence opt3 from hemagglutinin__InfluenzaB__AHL91354

SEQ ID NO: 149897 - RNA, 1755 nt, Artificial Sequence; identical to SEQ ID NO: 148495
  derived and/or modified sequence opt3 from hemagglutinin__InfluenzaB__AHL91365

SEQ ID NO: 149898 - RNA, 1755 nt, Artificial Sequence
  derived and/or modified sequence opt3 from hemagglutinin__InfluenzaB__AHL91376
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacugccaccccaacaaagagucauuucgcgaaucugaaagguaccaagacuaggggcaaauuguguccgacaugcuuaaacuguaccgaucuggacguugcucuagggcggcccaugugcgugggagucacgccuagcgccaaggcauccauccuccacgaagugcgcccaguaacuucuggcuguuuucccauuaugcaugaucgaaccaagauccgucaacugccuaaucuucugagagguuacgagaaaauaagguugucgacacagaacguuaucaaugccgaaaaggcuccagggggacccuaucggcucggcacuucaggcagcugcccuaacgcaaccagucgcuccggguucuuugccacaauggcuugggccgugccaagagacaauaacaaaaccgcgacgaauccgcugacugucgaggugccccacauuuguacaaaggaagaggaucagaucaccguguggggauuccauucugacaacaaaacucagaugaagaaucuguacggugauagcaacccucaaaaguuuacauccucagcaaauggcgucaccacgcacuauguuagucagauugggggauucccagaccagaccgaggauggcggucucccccagagcgggaggaucgugguagacuacauggugcaaaaaccuggaaagacaggcacuauagucuaucagcggggcauuuuacugccacagaaaguguggugcgccucugggcgcuccaagguuaucaaaggaucacuucccuugauuggugaagcugauugucugcacgagaaguacggcgggcuaaacaaaagcaagccguauuacaccggagaacaugccaaggcaaucggcaacugcccuaucugggugaaaacaccccucaagcuggcuaaugguacuaaauaccgaccuccagccaaacuucugaaggagagaggguuuuucggcgcgauugccggauuuuuggagggcgggugggaaggaaugauagcagguuggcacggcuauaccagucauggggcucacggagucgccguggcugccgaccucaagucuacacaggaggcaaucaacaagauuaccaaaaaucugaacuccuuaagcgaacuggagguaaagaaucuccaaaggcuuucgggcgccauggaugaacugcacaacgagaucuuggagcuagacgaaaaaguugacgaucugcgggcugacacuauaucuucccagauugagcucgcggugcugcuuucaaaugaagguaucaucaacagugaggaugaacaucuguuggcacucgagcguaagcugaaaaagauguuagggcccagcgccgucgacauuggcaauggauguuucgagacgaagcacaaaugcaaccagacaugccuggaucgcaucgcugccggcaccuuuaaugcaggggaguucucccuaccaacuuuugacucucucaacauuaccgccgcuagccugaaugaugacggacuugauaaccauacaauauugcuguacuauucaaccgccgcaaguucccucgcggugacucugaugaucgcuauuuucaucgucuacaugaucagcagagacaaugugucuuguucaauuugccuuuga

SEQ ID NO: 149899 - RNA, 1755 nt, Artificial Sequence
  derived and/or modified sequence opt3 from hemagglutinin__InfluenzaB__AHL91387
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccagccaagagucauuucgcgaaucugaaagguaccaagacuaggggcaaauuguguccgacaugcuuaaacuguaccgaucuggacguugcucuagggcggcccaugugcgugggagucacgccuagcgccaaggcauccauccuccacgaagugcgcccaguaacuucuggcuguuuucccauuaugcaugaucgaaccaagauccgucaacugccuaaucuucugagagguuacgagaaaauaagguugucgacacagaacguuaucaaugccgaaaaggcuccagggggacccuaucggcucggcacuucaggcagcugcccuaacgcaaccagucgcuccggguucuuugccacaauggcuugggccgugccaagagacaauaacaaaaccgcgacgaauccgcugacugucgaggugccccacauuuguacaaaggaagaggaucagaucaccguguggggauuccauucugacaacaaaacucagaugaagaaucuguacggugauagcaacccucaaaaguuuacauccucagcaaauggcgucaccacgcacuauguuagucagauugggggauucccagaccagaccgaggauggcggucucccccagagcgggaggaucgugguagacuacauggugcaaaaaccuggaaagacaggcacuauagucuaucagcggggcauuuuacugccacagaaaguguggugcgccucugggcgcuccaagguuaucaaaggaucacuucccuugauuggugaagcugauugucugcacgagaaguacggcgggcuaaacaaaagcaagccguauuacaccggagaacaugccaaggcaaucggcaacugcccuaucugggugaaaacaccccucaagcuggcuaaugguacuaaauaccgaccuccagccaaacuucugaaggagagaggguuuuucggcgcgauugccggauuuuuggagggcgggugggaaggaaugauagcagguuggcacggcuauaccagucauggggcucacggagucgccguggcugccgaccucaagucuacacaggaggcaaucaacaagauuaccaaaaaucugaacuccuuaagcgaacuggagguaaagaaucuccaaaggcuuucgggcgccauggaugaacugcacaacgagaucuuggagcuagacgaaaaaguugacgaucugcgggcugacacuauaucuucccagauugagcucgcggugcugcuuucaaaugaagguaucaucaacagugaggaugaacaucuguuggcacucgagcguaagcugaaaaagauguuagggcccagcgccgucgacauuggcaauggauguuucgagacgaagcacaaaugcaaccagacaugccuggaucgcaucgcugccggcaccuuuaaugcaggggaguucucccuaccaacuuuugacucucucaacauuaccgccgcuagccugaaugaugacggacuugauaaccauacaauauugcuguacuauucaaccgccgcaaguucccucgcggugacucugaugaucgcuauuuucaucgucuacaugaucagcagagacaaugugucuuguucaauuugccuuuga

SEQ ID NO: 149900 - RNA, 1755 nt, Artificial Sequence
  derived and/or modified sequence opt3 from hemagglutinin__InfluenzaB__AHL91409
augaaggccaucauugugcugcucauggucguuaccagcaacgcugacagaauaugcacaggcaucacuuccucugauucaccccacgugguaaaaacggcaacccagggggaagugaaugucacaggagccauuccucuuacuaccacaccaaccaagaguuacuucgcgaaccugaaagguacuaagacaaggggcaaauuguguccgaccugcuuaaauuguacggaccuggauguggcucuagggcggcccaugugcguuggaaucacuccuagcgccaaggcauccauucuccaugaagugcgcccagucaccucuggcuguuuucccaucaugcacgaccgaacaaagauacgucaacugccuaaccuucugagagguuaugagaaaaucagguugucgacucagaaugugauuaacgccgaaaaggcuccagggggacccuaccggcucggcaccucaggcagcugcccuaaugcaacaagucgcuccggguucuuugccaccauggcuugggccguaccaagagauaacaauaaaacggcgacuaacccgcugacaguugaggugccccauaucuguaccaaggaagaggaccagauuacugucuggggauuccacucugauaauaaaacacagaugaagaaccuguauggugacagcaauccucaaaaguuuaccuccucagcaaacggcaucacgacccauuacgugagucagauagggggauucccagaucagacagaggacggcggucucccccagagcgggaggauuguggucgauuauaugguucaaaaaccuggaaagacuggcaccaucguguaccagcggggcauuuuacugccacagaaaguauggugcgccucugggcgcuccaaggugaucaaaggaucacuucccuugaucggugaagcugacugucugcacgagaaguauggcgggcuaaauaaaagcaagccguacuacacaggagaacacgccaaggcaauuggcaacugcccuauaugggucaaaacuccccucaagcuggcuaacgguaccaaauaucgaccuccagccaagcugcugaaagagagaggguuuuucggcgcgaucgccggauuuuuggagggcgggugggaaggaaugguggcagguuggcauggcuacacaagucacggggcucauggaguugccguggcugccgaucucaagucuacccaggaggcaauuaauaagaucacuaaaaaccuuaauuccuuaagcgaacuggaggucaagaaccuccaaaggcuuucgggcgccauggacgaacugcacaaugagauauuggagcuagacgaaaaaguggaugaccugcgggcugauacgauuucuucccagaucgagcucgcgguacugcuuucaaacgaagguaucauuaauagugaggacgaacaccuguuggcacucgagcguaagcugaaaaagauguuagggcccagcgccguugauaucggcaacggauguuucgagacaaagcauaaaugcaaucagaccugccuggaccgcauugcugccggcacuuuuaacgcaggggaguucucccuaccaaccuuugauucucucaauauaacagccgcuagccugaacgacgauggacuugacaaucacaccaucuugcuguauuacucaacugccgcaaguucccucgcggugacacugaugauugcuaucuucaucgucuauaugauuagcagagauaacgugucuuguucaauaugccuuuga

SEQ ID NO: 149901 - RNA, 1755 nt, Artificial Sequence
  derived and/or modified sequence opt3 from hemagglutinin__InfluenzaB__AHL91431
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccucagcaaauggcaucacgacccacuaugugagucagauagggggauucccagaccagacagaggauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaagcugauugucugcacgagaaauacggcgggcuaaacaagagcaagccguauuacacaggagaacaugccaaagcaauuggcaacugcccuauaugggucaagacuccccucaaacuggcuaaugguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaccucaagucuacccaggaggcaaucaacaaaauaacuaagaaucugaacuucuuauccgaacuggaggugaaaaaucuccaaagacuuagcggcgccauggaugaacugcacaacgagauuuuggagcuagacgaaaaggucgacgaucugagggcugacacgaucucgucucagaucgagcucgcggugcugcuuuccaaugaagguauuaucaacucagaggaugaacaucuguuggcacucgagcggaaacugaagaagauguuagggcccagugccguagacauuggcaauggauguuuugagacaaaacacaagugcaaccagaccugccuggaucguauagcugccggcacuuucaaugcaggggaauuuagccuaccaaccuucgacucccucaacaucacagccgcuucucugaaugaugacggacuugauaaccauaccauuuugcuguacuauagcacugccgcaucaagucucgcgguuacacugaugaucgcuaucuucauuguguacaugauaucccgcgacaaugucagcuguucuaucugccuuuga

SEQ ID NO: 149902 - RNA, 1755 nt, Artificial Sequence
  derived and/or modified sequence opt3 from hemagglutinin__InfluenzaB__AHL91442
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaccgcuccagggggacccuaucggcucggcacaucaggcagcugcccuaacgcaaccaguaaguccggguucuuugccacgauggcuugggccguaccacgcgacaauaacaaaacugcgacaaauccgcugaccguugaggugccccacaucuguacuaaggaagaggaucagauuacagucuggggauuccauucugacaacaaaacccagaugaagaaucuguacggugauagcaacccucaaaaguuuacguccucagcaaauggcaucaccacacacuaugugagucagauagggggauucccagaccagacugaggauggcggucucccccagagcgggagaauuguggucgacuacaugguucaaaaaccuggaaagaccggcacaaucguguaucagaggggcauuuuacugccacagaaaguauggugcgccucugggcgguccaaggugaucaaaggaucacuucccuugaucggugaagcugauugucugcacgagaaguacggcgggcuaaacaaaagcaagccguauuacacuggagaacaugccaaggcaauuggcaacugcccuauaugggucaaaaccccucucaagcuggcuaaugguacaaaauaccgcccacccgccaaacuucugaaggagcgaggguuuuucggcgcgaucgccggauuuuuggagggcgggugggaaggaaugauugcagguuggcacggcuauaccagucauggggcucacggaguggccguugcugccgaccucaagucuacucaggaggcaaucaacaagauaacgaaaaaucugaacuccuuaagcgaacuggaggugaagaaucuccaaagacuuucgggcgccauggaugaacugcacaacgagauuuuggagcuagacgaaaaagucgacgaucugagggcugacacaaucucuucccagaucgagcucgcggugcugcuuucaaaugaagguauuaucaacagugaggaugaacaucuguuggcacucgagcggaagcugaaaaagauguuagggcccagcgccguagacauuggcaauggauguuucgagaccaagcacaaaugcaaccagacuugccuggaucguauagcugccggcaccuuuaaugcaggggaguucucccuaccaacauuugacucucucaacaucaccgccgcuagccugaaugaugacggacuugauaaccauacuauuuugcuguacuauucaacagccgcaaguucccucgcgguuacgcugaugaucgcuaucuucauuguguacaugauaagccgcgacaaugucucuuguucaaucugccuuuga

SEQ ID NO: 149903 - RNA, 1755 nt, Artificial Sequence
  derived and/or modified sequence opt3 from hemagglutinin__InfluenzaB__AHL91453
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaaucgagguuccccacguguguaccaaagaagaggaucagauuacugucuggggauuccauucugacaacaagacacagaugaagaaucuguacggugauagcaacccucaaaaauuuaccuccucagcaaauggcaucacgacccacuaugugagucagauagggggauucccagaccagacagaggauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaagcugauugucugcacgagaaauacggcgggcuaaacaagagcaagccguauuacacaggagaacaugccaaagcaauuggcaacugcccuauaugggucaagacuccccucaaacuggcuaaugguaccaaguaccgcccuccagccaaacuucugaaggagcgaggguuuuucggcgcgaucgccggauuuuuggagggcgggugggaaggaaugauugcagguuggcacggcuauacaagucauggggcucacggaguggccguugcugccgaccucaagucuacccaggaggcaaucaacaaaauaacuaagaaucugaacuccuuaagcgaacuggaggugaaaaaucuccaaagacuuucgggcgccauggaugaacugcacaacgagauuuuggagcuagacgaaaaggucgacgaucugagggcugacacgaucucuucccagaucgagcucgcggugcugcuuucaaaugaagguauuaucaacagugaggaugaacaucuguuggcacucgagcggaaacugaagaagauguuagggcccagcgccguagacauuggcaauggauguuucgagacaaaacacaagugcaaccagaccugccuggaucguauagcugccggcacuuuuaaugcaggggaguucucccuaccaaccuuugacucucucaacaucacagccgcuagccugaaugaugacggacuugauaaccauaccauuuugcuguacuauucaacugccgcaaguucccucgcgguuacacugaugaucgcuaucuucauuguguacaugauaagccgcgacaaugucucuuguucaaucugccuuuga

SEQ ID NO: 149904 - RNA, 1755 nt, Artificial Sequence; identical to SEQ ID NO: 148421
  derived and/or modified sequence opt3 from hemagglutinin__InfluenzaB__AHL91464

SEQ ID NO: 149905 - RNA, 1755 nt, Artificial Sequence; identical to SEQ ID NO: 148527
  derived and/or modified sequence opt3 from hemagglutinin__InfluenzaB__AHL91475

SEQ ID NO: 149906 - RNA, 1755 nt, Artificial Sequence; identical to SEQ ID NO: 149902
  derived and/or modified sequence opt3 from hemagglutinin__InfluenzaB__AHL91486

SEQ ID NO: 149907 - RNA, 1755 nt, Artificial Sequence; identical to SEQ ID NO: 149902
  derived and/or modified sequence opt3 from hemagglutinin__InfluenzaB__AHL91497

SEQ ID NO: 149908 - RNA, 1755 nt, Artificial Sequence; identical to SEQ ID NO: 149902
  derived and/or modified sequence opt3 from hemagglutinin__InfluenzaB__AHL91530

SEQ ID NO: 149909 - RNA, 1755 nt, Artificial Sequence; identical to SEQ ID NO: 148421
  derived and/or modified sequence opt3 from hemagglutinin__InfluenzaB__AHL91541

SEQ ID NO: 149910 - RNA, 1755 nt, Artificial Sequence; identical to SEQ ID NO: 149902
  derived and/or modified sequence opt3 from hemagglutinin__InfluenzaB__AHL91552

SEQ ID NO: 149911 - RNA, 1755 nt, Artificial Sequence; identical to SEQ ID NO: 149902
  derived and/or modified sequence opt3 from hemagglutinin__InfluenzaB__AHL91574

SEQ ID NO: 149912 - RNA, 1755 nt, Artificial Sequence
  derived and/or modified sequence opt3 from hemagglutinin__InfluenzaB__AHL91585
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccucagcaaauggcaugacgacccacuaugugagucagaucgggggauucccagaccagacagaggauggcggucucccccagagcgggagaauaguggucgacuacaugguucaaaagccuggaaaaacuggcaccauuguguaucagaggggcaucuuacugccacagaagguauggugcgccucugggcgguccaaagugauuaagggaucacuucccuugaucggugaagcugauugucugcacgagaaauacggcgggcuaaacaagagcaagccguauuacacaggagaacaugccaaagcaaucggcaacugcccuauuugggucaagacuccccucaaacuggcuaaugguaccaaguaccgcccuccagccaaacuucugaaggagcgaggguuuuucggcgcgauagccggauuuuuggagggcgggugggaaggaaugaucgcagguuggcacggcuauacaagucauggggcucacggaguggccguugcugccgaccucaagucuacccaggaggcaauuaacaaaaucacuaagaaucugaacuccuuaagcgaacuggaggugaaaaaucuccaaagacuuucgggcgccauggaugaacugcacaacgagauauuggagcuagacgaaaaggucgacgaucugagggcugacacgauuucuucccagaucgagcucgcggugcugcuuucaaaugaagguaucauuaacagugaggaugaacaucuguuggcacucgagcggaaacugaagaagauguuagggcccagcgccguagacaucggcaauggauguuucgagacaaaacacaagugcaaccagaccugccuggaucguauugcugccggcacuuuuaaugcaggggaguucucccuaccaaccuuugacucucucaacauaacagccgcuagccugaaugaugacggacuugauaaccauaccaucuugcuguacuauucaacugccgcaaguucccucgcgguuacacugaugauugcuaucuucaucguguacaugauuagccgcgacaaugucucuuguucaauaugccuuuga

SEQ ID NO: 149913 - RNA, 1755 nt, Artificial Sequence
  derived and/or modified sequence opt3 from hemagglutinin__InfluenzaB__AHL91596
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaguugaggugccccacaucuguaccaaagaagaggaucagauuacugucuggggauuccauucugacaacaagacacagaugaagaaucuguacggugauagcaacccucaaaaauuuaccuccucagcaaauggcaucacgacccacuaugugagucagauagggggauucccagaccagacagaggauggcggucucccccagagcgggagaauuguggucgacuacaugguucaaaagccuggaaaaacuggcaccaucguguaucagaggggcauuuuacugccacagaagguauggugcgccucugggcgguccaaagugaucaagggaucacuucccuugaucggugaagcugauugucugcacgagaaauacggcgggcuaaacaagagcaagccguauuacacaggagaacaugccaaagcaauuggcaacugcccuauaugggucaagacuccccucaaacuggcuaaugguaccaaguaccgcccuccagccaaaauccuuaaggagcgaggguuuuucggcgcgauugccggauuucuggagggcgggugggaaggaaugaucgcagguuggcacggcuauacaagucauggggcucacggaguggccguugcugccgacuugaagucuacccaggaggcaauaaacaaaauuacuaagaaucucaacucccugagcgaauuagaggugaaaaaucugcaaagacucucgggcgccauggaugaacuucacaacgagauccuggaguuggacgaaaaggucgacgaucuaagggcugacacgaucucuucccagauugagcuggcggugcuccugucaaaugaagguaucauuaacagugaggaugaacaucuucuggcauuggagcggaaacucaagaagaugcuggggcccagcgccguagacauaggcaauggauguuucgagacaaaacacaagugcaaccagaccugcuuagaucguaucgcugccggcacuuuuaaugcaggggaguucucccugccaaccuuugacucucuaaacauuacagccgcuagccucaaugaugacggacuggauaaccauaccauccuuuuguacuauucaacugccgcaaguucccuggcgguuacacucaugaucgcuauuuucauaguguacaugaucagccgcgacaaugucucuuguucaauuugccuguga

SEQ ID NO: 149914 - RNA, 1755 nt, Artificial Sequence; identical to SEQ ID NO: 149913
  derived and/or modified sequence opt3 from hemagglutinin__InfluenzaB__AHL91607

SEQ ID NO: 149915 - RNA, 1755 nt, Artificial Sequence
  derived and/or modified sequence opt3 from hemagglutinin__InfluenzaB__AHL91618
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaccgcuccagggggacccuaucggcucggcacaucaggcagcugcccuaacgcaaccaguaaguccggguucuuugccacgauggcuugggccguaccacgcgacaauaacaaaacugcgacaaauccgcugaccguugaggugccccacaucuguacuaaggaagaggaucagauuacagucuggggauuccauucugacaacaaaacccagaugaagaaucuguacggugauagcaacccucaaaaguuuacguccucagcaaauggcaucaccacacacuaugugagucagauagggggauucccagaccagacugaggauggcggucucccccagagcgggagaauuguggucgacuacaugguucaaaaaccuggaaagaccggcacaaucguguaucagaggggcauuuuacugccacagaaaguauggugcgccucugggcgguccaaggugaucaaaggaucacuucccuugaucggugaagcugauugucugcacgagaaguacggcgggcuaaacaaaagcaagccguauuacacuggagaacaugccaaggcaauuggcaacugcccuauaugggucaaaaccccucucaagcuggcuaaugguacaaaauaccgcccacccgccaaacuucugaaggagcgaggguuuuucggcgcgaucgccggauuuuuggagggcgggugggaaggaaugauugcagguuggcacggcuauaccagucauggggcucacggaguggccguugcugccgaccucaagucuacucaggaggcaaucaacaagauaacgaaaaaucugaacuccuuaagcgaacuggaggugaagaaucuccaaagacuuucgggcgccauggaugaacugcacaacgagauuuuggagcuagacgaaaaagucgacgaucugagggcugacacaaucucuucccagaucgagcucgcggugcugcuuucaaaugaagguauuaucaacagugaggaugaacaucuguuggcacucgagcggaagcugaaaaagauguuagggcccagcgccguagacauuggcaauggauguuucgagaccaagcacaaaugcaaccagacuugccuggaucguauagcugccggcaccuuuaauguuggggaguucucccuaccaacauuugacucucucaacaucaccgcagccagccugaaugaugacggacuugauaaccauacuauuuugcuguacuauucaacagcugccaguucccucgcagugacgcugaugaucgcgaucuucauugucuacaugauaagccgcgacaaugugucuuguucaaucugccuuuga

SEQ ID NO: 149916 - RNA, 1755 nt, Artificial Sequence
  derived and/or modified sequence opt3 from hemagglutinin__InfluenzaB__AHL91629
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuuaacuguacggauuuagacguggcucuggggcggcccaugugcguuggaaucacuccuagcgccaaggcauccauucuacacgaagugcgcccagucaccucuggcuguuuccccaucaugcaugaucgaacaaagauacgucaacucccuaaucugcuuagagguuacgagaaaaucaggcugucgacucagaacgugauugacgccgaaaaggcuccagggggacccuauaaauugggcaccucaggcagcugcccuaaugcaacaaguaaguccggguuuuucgccaccauggcuugggccguaccacgggauaacaauaaaacggcgacuaacccgcucacaguugaggugccccacaucuguaccaaggaagaggaccagauuacugucuggggauuucauucugauaauaagacacagaugaaaaaccuguacggugacagcaauccucaaaaguucaccuccucagcaaacggcaucacgacccacuaugugagucagauagggggauuuccagaucagacagaggacggcggucugccccagagcgggcgcauuguggucgauuacaugguucaaaaaccuggaaagacuggcaccaucguguaucagagaggcauucucuuaccacagaaaguauggugcgccucugggagguccaaggugaucaaaggaucacugccccuuaucggugaagcugacuguuugcacgagaaguacggcgggcugaauaagagcaaaccguauuacacaggagaacaugccaaggcaauuggcaacugcccuauaugggucaaaacuccccuaaagcucgcuaacgguaccaaauaccggccuccagccaagcugcuuaaggagcgcggguucuuuggcgcgaucgccggauuccuggagggcgggugggaaggaaugauugcagguuggcacggcuauacaagucauggggcucacggaguggccguugcugccgauuugaaaucuacccaggaggcaaucaauaagauaacuaaaaaccucaauucccugagcgaauuagaggugaagaaccugcaacgacucucgggcgccauggacgaacuucacaaugagauucuggaguuggacgaaaaagucgaugaccuaagagcugauacgaucucuucccagaucgagcuggcggugcuccugucaaacgaagguauuaucaauagugaggacgaacaucuucuggcauuggagaggaagcucaagaaaaugcuggggcccagcgccguagauauuggcaacggauguuuugagacaaagcacaaaugcaaucagaccugcuuagaccggauagcugccggcacuuucaacgcaggggaauuuucccugccaaccuucgauucucuaaauaucacagccgcuagccucaacgacgauggacuggacaaucauaccauucuuuuguacuauucaacugccgcaaguucccuggcgguuacacucaugaucgcuaucuucauuguguacaugauaagccgugauaacgucucuuguucaaucugccuguga

SEQ ID NO: 149917 - RNA, 1755 nt, Artificial Sequence; identical to SEQ ID NO: 149916
  derived and/or modified sequence opt3 from hemagglutinin__InfluenzaB__AHL91640

SEQ ID NO: 149918 - RNA, 1755 nt, Artificial Sequence; identical to SEQ ID NO: 148423
  derived and/or modified sequence opt3 from hemagglutinin__InfluenzaB__AHL91651

SEQ ID NO: 149919 - RNA, 1752 nt, Artificial Sequence
  derived and/or modified sequence opt3 from hemagglutinin__InfluenzaB__AHL91662
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaccgcuccagggggacccuaucggcucggcacaucaggcagcugcccuaacgcaaccaguaaguccggguucuuugccacgauggcuugggccguaccacgcgacaauaacaaaacugcgacaaauccgcugaccguugaggugccccacaucuguacuaaggaagaggaucagauuacagucuggggauuccauucugacaacaaaacccagaugaagaaucuguacggugauagcaacccucaaaaguuuacguccucagcaaauggcaucaccacacacuaugugagucagauagggggauucccagaccagacugaggauggcggucucccccagagcgggagaauuguggucgacuacaugguucaaaaaccuggaaagaccggcacaaucguguaucagaggggcauuuuacugccacagaaaguauggugcgccucugggcgguccaaggugaucaaaggaucacuucccuugaucggugaagcugauugucugcacgagaaguacggcgggcuaaacaaaagcaagccguauuacacuggagaacaugccaaggcaauuggcaacugcccuauaugggucaaaaccccucucaagcuggcuaaugguacaaaauaccgcccacccgccaaacuucugaaggagcgaggguuuuucggcgcgaucgccggauuuuuggagggcgggugggaaggaaugauugcagguuggcacggcuauaccagucauggggcucacggaguggccguugcugccgaccucaagucuacucaggaggcaaucaacaagauaacgaaaaaucugaacuccuuaagcgaacuggaggugaagaaucuccaaagacuuucgggcgccauggaugaacugcacaacgagauuuuggagcuagacgaaaaagucgacgaucugagggcugacacaaucucuucccagaucgagcucgcggugcugcuuucaaaugaagguauuaucaacagugaggaugaacaucuguuggcacucgagcggaagcugaaaaagauguuagggcccagcgccguagacauuggcaauggauguuucgagaccaagcacaaaugcaaccagacuugccuggaucguauagcugccggcaccuuuaaugcaggggaguucucccuaccaacauuugacucucucaacaucaccgccgcuagccugaaugauggacuugacaaccauacuauuuugcuguacuauucaacagccgcaaguucccucgcgguuacgcugaugaucgcuaucuucauuguguacaugauaagccgcgauaaugucucuuguucaaucugccuuuga

SEQ ID NO: 149920 - RNA, 1755 nt, Artificial Sequence; identical to SEQ ID NO: 148527
  derived and/or modified sequence opt3 from hemagglutinin__InfluenzaB__AHL91673

SEQ ID NO: 149921 - RNA, 1755 nt, Artificial Sequence
  derived and/or modified sequence opt3 from hemagglutinin__InfluenzaB__AHL91684
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagagucauuucgcgaaucugaaagguacuaagacaaggggcaaauuguguccgaccugcuuaaacuguacggaucuggacguggcucuagggcggcccaugugcguuggaaucacuccuagcgccaaggcauccauucuccacgaagugcgcccagucaccucuggcuguuuucccaucaugcaugaucgaacaaagauacgucaacugccuaaucuucugagagguuacgagaaaaucagguugucgacucagaacgugauuaaugccgaaaaggcuccagggggacccuaucggcucggcaccucaggcagcugcccuaacgcaacaaguaaauccggguucuuugccaccauggcuugggccguaccacgcgacaauaacaagacggcgacuaauccgcugacaaucgagguuccccacauuuguaccaaagaagaggaucagaucacuguguggggauuccauucugacaacaagacacagaugaagaaucuguacggugauagcaacccucaaaaauuuaccuccucagcaaauggcauaacgacccacuaugucagucagauugggggauucccagaccagacagaggauggcggucucccccagagcgggagaaucgugguggacuacaugguccaaaagccuggaaaaacuggcaccauuguuuaucagaggggcaucuuacugccacagaagguguggugcgccucugggcgguccaaaguaaucaagggauuucuucccuugauuggugaagcugauugucugcacgagaaauacggcgggcuaaacaagucaaagccguauuacacaggagaacaugccaaagcaauaggcaacugcccuaucugggugaagacuccccucaaacuggcuaaugguaccaaguaccgcccuccagccaaacuucugaaggagcgaggguucuuuggcgcgauugccggauucuuggagggcgggugggaaggaaugaucgcagguuggcacggcuauacaagccauggggcucacggagucgccguggcugccgaccucaagaguacccaggaggcaauaaacaaaauuacuaagaaucugaacucuuuauccgaacuggagguuaaaaaucuccaaagacuuagcggcgccauggaugaacugcacaacgagaucuuggagcuagacgaaaagguggacgaucugagggcugacacgaucucgucucagauugagcucgcgguccugcuuuccaaugaagguaucauuaacucagaggaugaacaucuguuggcacucgagcggaaacugaagaagauguuagggcccagugccguggacauaggcaauggauguuuugagacaaaacacaagugcaaccagaccugccuggaucguaucgcugccggcacuuucaaugcaggggaauuuagccuaccaaccuucgacucccucaacauuacagccgcuucucugaaugaugacggacuugauaaccauaccaucuugcuguacuauagcacugccgcaucaagucucgcgguaacacugaugaucgcuauuuucauaguuuacaugaucucccgcgacaaugugagcuguucuauuugccuuuga

SEQ ID NO: 149922 - RNA, 1755 nt, Artificial Sequence; identical to SEQ ID NO: 148423
  derived and/or modified sequence opt3 from hemagglutinin__InfluenzaB__AHL91695

SEQ ID NO: 149923 - RNA, 1755 nt, Artificial Sequence; identical to SEQ ID NO: 148527
  derived and/or modified sequence opt3 from hemagglutinin__InfluenzaB__AHL91706

SEQ ID NO: 149924 - RNA, 1758 nt, Artificial Sequence; identical to SEQ ID NO: 148995
  derived and/or modified sequence opt3 from hemagglutinin__InfluenzaB__AHL91717

SEQ ID NO: 149925 - RNA, 1758 nt, Artificial Sequence; identical to SEQ ID NO: 148995
  derived and/or modified sequence opt3 from hemagglutinin__InfluenzaB__AHL91728

SEQ ID NO: 149926 - RNA, 1758 nt, Artificial Sequence; identical to SEQ ID NO: 148995
  derived and/or modified sequence opt3 from hemagglutinin__InfluenzaB__AHL91739

SEQ ID NO: 149927 - RNA, 1755 nt, Artificial Sequence; identical to SEQ ID NO: 148527
  derived and/or modified sequence opt3 from hemagglutinin__InfluenzaB__AHL91750

SEQ ID NO: 149928 - RNA, 1758 nt, Artificial Sequence; identical to SEQ ID NO: 148995
  derived and/or modified sequence opt3 from hemagglutinin__InfluenzaB__AHL91761

SEQ ID NO: 149929 - RNA, 1758 nt, Artificial Sequence
  derived and/or modified sequence opt3 from hemagglutinin__InfluenzaB__AHL91772
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcuaaaguguccauucuccacgaaguccgcccagugacuucuggcuguuuucccaucaugcaugaucgaaccaagauacgucaacugccuaaccuucugagagguuacgagcacaucagguugucgacacauaauguaauuaacgccgaaaaagcaccagggggacccuauaagaucggcacuucaggcagcugcccuaauauuaccaacgggaauggauucuuugccacaauggcuugggcaguuccgaaaaacgacaauaacaagaccgccacgaauagucucacuaucgaggugccauacauauguacagaaggugaggaucagauuaccgucuggggcuuccacuccgacaacgagacucagauggcuaagcuguauggggauucuaaaccccagaaguuuacaagcuccgccaacggagugaccacgcacuacgugucacaaaucggcgguuucccuaaucagaccgaagacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcucacugccucuuauaggggaggcagacuguuugcaugaaaaguauggaggccugaacaagagcaaaccauacuacacaggugagcacgccaaggcuaucgggaauugccccauuugggucaaaacuccgcuaaagcucgccaacggcaccaaauauaggccucccgcaaagcugcuuaaggagcggggauuuuucggcgcuaucgccggguuucuggaaggagguugggagggcaugauagcgggguggcauggauacacaagucacggcgcccacgguguggcaguugcugccgauuugaaaucuacccaggaagcuauuaauaagaucacuaaaaaccucaauucccugagcgaguuagaagugaagaaccugcagcgccucucgggggccauggacgagcuucauaaugagauccuggaauuggaugagaaagucgacgaccuacgagcagauacgauuucuucccaaaucgaacuggccgugcuccugucaaacgagggcauuauaaauagugaagacgagcaccuucuggcuuuggagagaaagcucaagaaaaugcugggaccaagcgcgguagaaaucggcaacggguguuucgagacaaagcauaaaugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucguggucuauauggugagccgggauaacgucucuuguucaaucugccuguga

SEQ ID NO: 149930 - RNA, 1758 nt, Artificial Sequence; identical to SEQ ID NO: 149929
  derived and/or modified sequence opt3 from hemagglutinin__InfluenzaB__AHL91783

SEQ ID NO: 149931 - RNA, 1758 nt, Artificial Sequence; identical to SEQ ID NO: 149929
  derived and/or modified sequence opt3 from hemagglutinin__InfluenzaB__AHL91794

SEQ ID NO: 149932 - RNA, 1758 nt, Artificial Sequence
  derived and/or modified sequence opt3 from hemagglutinin__InfluenzaB__AHL91805
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuuaacuguaccgauuuagacguugcgcuggggcggcccaagugcacgggaaauaucccuagcgcugaaguguccauucuacacgagguccgcccagugacuucuggcuguuuccccaucaugcaugaucgaaccaaaauacgucaacucccuaaccugcuuagagguuacgaacacaucaggcugucgacacauaauguaauuaacgccgagaaggcaccagggggacccuauaaaaucggcacuucaggcagcugcccuaauguuaccaacgggaauggauuuuucgccacaauggcuugggcagugccaaagaacgacaauaacaaaaccgccacgaauaguuugacuauugaagucccguacaucuguacagagggugaggaucagauaaccguguggggcuuucacuccgacaacgaaacucagauggcuaagcucuauggggauucuaagccccagaaauucacaagcuccgccaacggagugaccacgcacuacgucucacaaauuggcgguuuuccuaaucagaccgaggacgggggacugccacagaguggccggaucguuguggauuauaugguacagaaguccggcaaaacagggacuauuaccuaccaacgcggaauccugcucccccagaagguguggugcgcgucugguagauccaaagucaucaagggcucauuaccucugauuggggaagcagacugucuucaugagaaauauggaggcuugaacaagagcaagccauacuacacaggugagcacgccaaagcuauagggaauugccccaucugggugaagacuccgcugaaacuagccaacggcaccaaguauaggccucccgcaaaacuccugaaggaacggggauucuuuggcgcuauugccggguuccuugagggagguugggaaggcaugaucgcgggguggcauggauacacaagucacggcgcccacgguguugcaguggcugccgaucugaagucuacccaggaggcuauaaauaaaauuacuaagaacuugaauagccucagcgaacuggaggucaaaaacuuacagcgccugucgggggccauggacgagcuccauaaugaaauccuugagcuggaugaaaagguggacgacuugcgagcagauacgaucucuucccaaauugagcuagccguacugcucucaaacgaaggcaucauuaauagugaggacgagcaucugcuugcucuggaaagaaaauugaagaagaugcucggaccaagcgcgguugagauaggcaacggguguuuugaaacaaaacacaagugcaaucagaccugccuggauaggaucgcagccggaacuuucgacgcuggugaguuuuccuuaccuaccuucgauucucugaacauuacagccgcaagccuaaaugacgauggccucgacaaccacaccauccugcuuuauuacucaacugccgcuaguuccuuggccgugacacugaugaucgcaauuuucgucguguauauggucagccgggauaacgugucuuguucaauaugccucuga

SEQ ID NO: 149933 - RNA, 1758 nt, Artificial Sequence; identical to SEQ ID NO: 148435
  derived and/or modified sequence opt3 from hemagglutinin__InfluenzaB__AHL91816

SEQ ID NO: 149934 - RNA, 1758 nt, Artificial Sequence; identical to SEQ ID NO: 148435
  derived and/or modified sequence opt3 from hemagglutinin__InfluenzaB__AHL91827

SEQ ID NO: 149935 - RNA, 1755 nt, Artificial Sequence; identical to SEQ ID NO: 149042
  derived and/or modified sequence opt3 from hemagglutinin__InfluenzaB__AHL91838

SEQ ID NO: 149936 - RNA, 1755 nt, Artificial Sequence
  derived and/or modified sequence opt3 from hemagglutinin__InfluenzaB__AHL91849
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaagcacgaccagucaccucuggcuguuuucccauuaugcacgaccguacaaagaucagacaacugccuaaucuucugagggguuaugagaacauacgguugucgacucagaaugugaucgaugccgaaaacgcuccagggggacccuaccgccucggcaccucaggcagcugcccuaaugcaacaaguaaguccggguucuuugccaccauggcuugggccguaccaaaagacaacaauaagaacgcgacgaauccgcugacuguugaggugcccuauauuuguaaagaaggagaggaucagaucacagucugggguuuccauucugacaacaagacccagaugaaaaaucuguacggcgauagcaacccucaaaaguuuacuuccucagcaaacggggugacaacccacuaugugagucagauuagcggauucccagcccagacggaggacggcggucucccccagucugggagaaucgucguugauuacauggugcaaaagccuaggaaaaccggaacaauaguauaucagcggggcguguuacugccacagaaggucuggugcgcuuccggccgcucaaaagugauuaaggggagccuucccuugaucggagaagccgacugucugcaugagaaauacgguggccuaaauaagaguaaaccguacuauacuggggaacacgcaaaggcuauuggaaacugcccuaucuggguuaagaccccacucaaacuggccaauggcacaaaguaccgacccccugcgaaacuucugaaggagagagguuucuucggggccaucgcaggcuuuuuggagggaggcugggaagggaugauugcuggauggcacgguuauacuucucauggcgcccacgggguggcugucgccgcagaucucaaauccacccaggaggccauaaacaagaucacaaagaaucugaacagcuuaucggaacuggaggugaaaaaucuccaaaggcuuucuggagcuauggacgaacugcauaacgagauuuuggagcuagacgaaaagguagaugaccugcgggcggauaccaucuccucacagauagagcucgcaguucugcuuaguaaugaaggcauuaucaacagcgaggacgaacaccuguuggcccucgagcguaaacugaagaaaauguuaggucccuccgcuguggauaucgggaauggcuguuucgagacuaagcacaagugcaaccagacgugccuggaccgcauugccgcaggaacauuuaaugccggcgaauuuucucuaccaaccuuugauagccucaacaucacugcugccucacugaaugacgaugggcuugacaaccauaccauuuugcuguacuauaguacagcagcguccagccucgcugucacccugaugcuugccauauucaucguguacauggucucuagagauaacgugucauguaguauuugccuguga

SEQ ID NO: 149937 - RNA, 1755 nt, Artificial Sequence
  derived and/or modified sequence opt3 from hemagglutinin__InfluenzaB__AHL91860
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagauucccuauaucuguacagaaggagaggaucagauuaccgucugggguuuccauucugacaauaagacucagaugaaaaaccuguacggcgauagcaauccucaaaaguuuacauccucagcgaacggggugaccacgcacuaugugagucagaucggaggcuucccagaccagaccgaggauggugggcucccccagagcggaagaauagucguugacuacaugaugcaaaagccuggcaaaacaggcacuauuguguaucagaggggaguauuacugccacagaagguguggugcgcaucugggcgguccaaagucaucaaggguucacuucccuugauuggcgaagccgauugucugcaugagaaauacgggggacuaaacaagagcaaaccguacuauaccggcgaacacgcuaaggccaucgguaauugcccuaucugggugaagacaccccucaaacuggcaaacgggacuaaguaccgcccuccagcuaaacuucugaaggagcgaggcuuuuucggagccauugcgggcuuuuuggaagggggaugggaggguaugauagccggcuggcacggguauaccagucauggagcacacggcguugcuguggccgcugaccucaaaucuacacaggaggccaucaauaagauuaccaagaacuuaaauucccugagcgaacuggaggucaaaaaccuccaaagacuuucgggugcaauggacgaacugcauaaugagaucuuggagcuagaugaaaagguggacgaucugagggccgacacuauaucuucccagauugagcucgcuguacugcuuucaaacgaagggaucaucaauagugaggaugaacaccuguuggcgcucgagcggaaacugaagaaaauguuaggccccagcgcaguugagauuggaaacggcuguuucgaaacgaagcacaagugcaaucagacaugccuggaccguaucgccgcugggaccuuuaacgccggagaguucucccuaccaacuuuugauucucucaauauuaccgcagccagccugaacgacgauggucuugacaaucaugcuauauugcuguacuauucaacagccgcaaguucccucgcggugacccugaugcuugcuaucuucauugucuacauggugagccgcgauaacgucucuuguucaaucugccuguga

SEQ ID NO: 149938 - RNA, 1755 nt, Artificial Sequence
  derived and/or modified sequence opt3 from hemagglutinin__InfluenzaB__AHL91871
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagauucccuauaucuguacagaaggagaggaucagauuaccgucugggguuuccauucugacaauaagacucagaugaaaaaccuguacggcgauagcaauccucaaaaguuuacauccucagcgaacggggugaccacgcacuaugugagucagaucggaggcuucccagaccagaccgaggauggugggcucccccagagcggaagaauagucguugacuacaugaugcaaaagccuggcaaaacaggcacuauuguguaucagaggggaguauuacugccacagaagguguggugcgcaucugggcgguccaaagucaucaaggguucacuucccuugauuggcgaagccgauugucugcaugagaaauacgggggacuaaacaagagcaaaccguacuauaccggcgaacacgcuaaggccaucgguaauugcccuaucugggugaagacaccccucaaacuggcaaacgggacuaaguaccgcccuccagcuaaacuucugaaggagcgaggcuuuuucggagccauugcgggcuuuuuggaagggggaugggaggguaugauagccggcuggcacggguauaccagucauggagcacacggcguugcuguggccgcugaccucaaaucuacacaggaggccaucaauaagauuaccaagaacuuaaauucccugagcgaacuggaggucaaaaaccuccaaagacuuucgggugcaauggacgaacugcauaaugagaucuuggagcuagaugaaaagguggacgaucugagggccgacacuauaucuucccagauugagcucgcuguacugcuuucaaacgaagggaucaucaauagugaggaugaacaccuguuggcgcucgagcggaaacugaagaaaauguuaggccccagcgcaguugagauuggaaacggcuguuucgaaacgaagcacaagugcaaucagacaugccuggaccguaucgccgcugggaccuuuaacgccggagaguucucccuaccaacuuuugauucucucaauauuaccgcagccagccugaacgacgauggucuugacaaucauacaauauugcuguacuauucaaccgcugccaguucccucgcagugacucugaugcuugcgaucuucauugucuacauggugagccgcgauaacgucucuuguucaaucugccuguga

SEQ ID NO: 149939 - RNA, 1755 nt, Artificial Sequence; identical to SEQ ID NO: 148442
  derived and/or modified sequence opt3 from hemagglutinin__InfluenzaB__AHL91882

SEQ ID NO: 149940 - RNA, 1755 nt, Artificial Sequence
  derived and/or modified sequence opt3 from hemagglutinin__InfluenzaB__AHL91904
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaguaaauccggguucuuugccaccauggcuugggccguuccuaaggacaauaacaaaaaugcgacgaacccacugacuguggaggucccguauauuuguacagaaggagaggaucagaucaccgugugggguuuccauucugacaauaagacucagaugaaaaaccuguacggcgauagcaauccccaaaaguuuacauccucagcaaacggggugaccacgcacuaugucagucagauuggaggcuucccugaccagaccgaggauggugggcucccacagagcggaagaaucguuguggacuacaugaugcaaaagcauggcaaaacaggcacuauaguauaucagaggggaguguuacugccccagaaggucuggugcgccucugggcgguccaaagugauuaaggguucacuuccuuugaucggcgaagcugauugucugcacgagaaauacgggggacuaaacaagagcaaaccauacuauaccggcgaacacgccaaggcaauugguaauugccccaucuggguuaagacaccgcucaaacuggcuaacgggacuaaguaccgcccucccgccaaacuucugaaggagcgaggcuuuuucggagcgaucgccggcuuuuuggaagggggaugggaagguaugauugcaggcuggcauggguauaccagucacggagcucauggcguggccgucgcugccgaccucaaaucuacacaggaggcaauaaauaagaucaccaagaacuuaaauucccugagcgaacuggaggugaaaaaccuccaaagacuuucgggugccauggacgaacugcacaaugagauuuuggagcuagaugaaaagguagacgaucugagggcugacacuaucucuucccagauagagcucgcgguucugcuuucaaacgaagggauuaucaauagugaggaugaacaccuguuggcacucgagcggaaacugaagaaaauguuaggcccaagcgccguggacaucggaaacggcuguuucgagacgaagcauaagugcaaucagacaugccuggaucguauugcugccgggaccuuuaacgcaggagaguucucccuaccuacuuuugacucucucaauaucaccgccgcuagccugaacgaugacggucuugauaaucacacaauuuugcuguacuauucaaccgccgcaaguucccucgcggucacucugaugcuugcuauauucaucguguacauggucagccgcgacaacgugucuuguucaauuugccuguga

SEQ ID NO: 149941 - RNA, 1755 nt, Artificial Sequence
  derived and/or modified sequence opt3 from hemagglutinin__InfluenzaB__AHL91915
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauuauaaaaacgccacgaauccgcugacuguggagguccccuacauuuguacagaaggagaggaucagaucaccgugugggguuuccauucugacaacaagacucagaugaaaaaucuguauggcgauagcaacccucaaaaguuuacauccucagcgaauggggugaccacgcacuacgucagucagauuggaggcuucccagaccagaccgaggauggugggcucccccagagcggaagaaucguuguggacuauaugaugcaaaagccuggcaaaacaggcacuauaguauaccagaggggaguguuacugccacagaaggucuggugcgcaucugggcgguccaaagugauuaaggguucacuucccuugaucggcgaagccgauugucugcaugagaaauacgggggacuaaacaagagcaaaccguauuacaccggcgaacacgcuaaggccauugguaacugcccuaucuggguuaagacaccccucaaacuggcaaaugggacuaaguaucgcccuccagcuaaacuucugaaggagcgaggcuuuuucggagccaucgcgggcuuuuuggaagggggaugggaagguaugauugccggcuggcacggguacaccagucauggagcacacggcguggcugucgccgcugaccucaaaucuacacaggaggccauaaacaagaucaccaagaaucugaacuccuuaagcgaacuggaggugaaaaaucuccaaagacuuucgggugcaauggacgaacugcauaacgagauuuuggagcuagaugaaaagguagacgaucugagggccgacacuaucucuucccagauagagcucgcuguucugcuuucaaaugaagggauuaucaacagugaggaugaacaccuguuggcgcucgagcggaaacugaagaaaauguuaggccccagcgcaguggacaucggaaauggcuguuucgagacgaagcacaagugcaaccagacaugccuggaucguauugccgcugggaccuuuaaugccggagaguucucccuaccaacuuuugacucucucaacaucaccgcagccagccugaaugaugacggucuugauaaccauacaauuuugcuguauuacucaaccgcugccaguucccucgcagucacucugaugcuugcgauauucaucguguauauggucagccgcgacaaugugucuuguucaauuugccuguga

SEQ ID NO: 149942 - RNA, 1755 nt, Artificial Sequence; identical to SEQ ID NO: 149040
  derived and/or modified sequence opt3 from hemagglutinin__InfluenzaB__AHL91926

SEQ ID NO: 149943 - RNA, 1755 nt, Artificial Sequence; identical to SEQ ID NO: 149615
  derived and/or modified sequence opt3 from hemagglutinin__InfluenzaB__AHL91937

SEQ ID NO: 149944 - RNA, 1755 nt, Artificial Sequence; identical to SEQ ID NO: 148442
  derived and/or modified sequence opt3 from hemagglutinin__InfluenzaB__AHL91948

SEQ ID NO: 149945 - RNA, 1758 nt, Artificial Sequence
  derived and/or modified sequence opt3 from hemagglutinin__InfluenzaB__AHL91959
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgccagcuucaaugacgauggccucgacaaccacaccauccugcuuuauuacucaacugcagcuaguuccuuggccguuacacugaugauugcaauauucguggucuauauggugagccgggauaacgucucuuguucaaucugccucuga

SEQ ID NO: 149946 - RNA, 1758 nt, Artificial Sequence; identical to SEQ ID NO: 148654
  derived and/or modified sequence opt3 from hemagglutinin__InfluenzaB__AHL91970

SEQ ID NO: 149947 - RNA, 1755 nt, Artificial Sequence
  derived and/or modified sequence opt3 from hemagglutinin__InfluenzaB__AHL91991
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacuggcaaaucuucugagggguuaugagaacauacgguugucgacucagaauguaaucgaugccgaaaaggcuccugggggaccauaccgccucggcaccucaggcagcugccccaacgcaacaaauaaaaguggguucuuugccaccauggcuugggccguuccuaaggacaacaauaaaaacgcgacgaauccacugacuguggaggucccguauauuuguacagaaggagaggaucagaucaccgugugggguuuccauuccgacaacaagacucagaugaaaaaucuguacggcgauucuaacccccaaaaguuuacaagcuccgcaaacggggugaccacgcacuaugucucacagauuggaggcuucccugaccagaccgaggauggugggcucccacagaguggaagaaucguuguggacuacaugaugcaaaagcccggcaaaacaggcacuauaguauaucagcgcgggguguuacugccucagaaggucuggugcgccagcggacggucuaaagugauuaaggguucccuuccauugaucggcgaagcugauugucugcaugagaaauacgggggacuaaauaagucaaaacccuacuauaccggcgaacacgccaaggcaauugguaacugcccgaucuggguuaagacaccucucaaacuggcuaaugggacuaaguacaggcccccagccaaacuucugaaggagcgaggcuuuuucggagcgaucgccggcuuuuuggaagggggaugggaagguaugauugcaggcuggcacggguauaccagccauggagcucacggcguggccgucgcugccgaccucaaaaguacacaggaggcaauaaacaagaucaccaagaaucugaacucuuuauccgaacuggaggugaaaaaucuccaaagacuuagcggugccauggacgaacugcauaacgagauuuuggagcuagaugaaaagguagacgaucugagggcugacacuaucucgucucagauagagcucgcgguucugcuuuccaaugaagggauuaucaacucagaggaugaacaccuguuggcacucgagcggaaacugaagaaaauguuaggcccuagugccguggacaucggaaauggcuguuucgagacgaagcacaagugcaaccagacaugccuggaucguauugcugccgggaccuuuaaugcaggagaguucagccuacccacuuuugacucccucaacaucaccgccgcuucucugaaugaugacggucuugauaaccauacaauuuugcuguacuauagcaccgccgcaucaagucucgcggucacucugaugcuugcuauauucaucguguacauggucucccgcgacaacgugagcuguucuauuugccuguga

SEQ ID NO: 149948 - RNA, 1758 nt, Artificial Sequence; identical to SEQ ID NO: 148530
  derived and/or modified sequence opt3 from hemagglutinin__InfluenzaB__AHL92002

SEQ ID NO: 149949 - RNA, 1758 nt, Artificial Sequence; identical to SEQ ID NO: 148530
  derived and/or modified sequence opt3 from hemagglutinin__InfluenzaB__AHL92013

SEQ ID NO: 149950 - RNA, 1758 nt, Artificial Sequence; identical to SEQ ID NO: 148530
  derived and/or modified sequence opt3 from hemagglutinin__InfluenzaB__AHL92024

SEQ ID NO: 149951 - RNA, 1758 nt, Artificial Sequence; identical to SEQ ID NO: 148530
  derived and/or modified sequence opt3 from hemagglutinin__InfluenzaB__AHL92035

SEQ ID NO: 149952 - RNA, 1758 nt, Artificial Sequence; identical to SEQ ID NO: 148530
  derived and/or modified sequence opt3 from hemagglutinin__InfluenzaB__AHL92046

SEQ ID NO: 149953 - RNA, 1758 nt, Artificial Sequence; identical to SEQ ID NO: 148530
  derived and/or modified sequence opt3 from hemagglutinin__InfluenzaB__AHL92057

SEQ ID NO: 149954 - RNA, 1758 nt, Artificial Sequence
  derived and/or modified sequence opt3 from hemagglutinin__InfluenzaB__AHL92068
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacauuaccaaugggaacggauucuuugccacaauggcuugggcaguuccaaagaaugacaacaauaaaaccgccacgaacagucucacuaucgaagugccguacauauguacagagggugaggaucagauuaccgucuggggcuuccacuccgacaacgaaacucagauggcuaagcuguauggggauucuaaaccccagaaguuuacaagcuccgccaauggagugaccacgcacuacgugucacaagucggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcagccggaacuuuugacgcuggugaguucucccugccuaccuuugauucucuaaauauuacagccgcaagccucaacgacgauggccuggacaaccacaccauccuuuuguauuacucaacugccgcuaguucccuggccgugacacucaugaucgcaauuuucgucguguauauggucagccgugauaaugugucuuguucaauaugccuguga

SEQ ID NO: 149955 - RNA, 1758 nt, Artificial Sequence
  derived and/or modified sequence opt3 from hemagglutinin__InfluenzaB__AHL92079
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacauuaccaaugggaacggauucuuugccacaauggcuugggcaguuccaaagaaugacaacaauaaaaccgccacgaacagucucacuaucgaagugccguacauauguacagagggugaggaucagauuaccgucuggggcuuccacuccgacaacgaaacucagauggcuaagcuguauggggauucuaaaccccagaaguuuacaagcuccgccaauggagugaccacgcacuacgugucacaaaucggcgguuucccuaaccagaccgaggacgggggacugccacagaguggccgcauugucguugauuauauggugcaaaagagcggcaaaacagggacuaucaccuaccagagaggaauccucuuaccccagaagguauggugcgcgucugguagguccaaagugauuaagggcucacugccucuuauaggggaagcagacuguuugcaugagaaauauggaggccugaauaagagcaaaccauacuacacaggugagcacgccaaggcuaucgggaacugccccauuugggucaagacuccgcuaaaacucgccaauggcaccaaguaucggccucccgcaaaacugcuuaaggaacgcggauuuuucggcgcuaucgccggguuucuggagggagguugggaaggcaugauagcgggguggcauggauacacaagucacggcgcccacgguguggcaguugcugccgauuugaaaucuacccaggaggcuauuaacaagaucacuaagaaucucaacucccugagcgaauuagaggugaaaaaucugcagcgacucucgggggccauggacgagcuucauaacgaaauccuggaguuggaugaaaaggucgacgaccuaagagcagauacgauuucuucccaaaucgagcuggccgugcuccugucaaaugaaggcauuauaaacagugaggacgagcaccuucuggcuuuggaaaggaaacucaagaaaaugcugggaccaagcgcgguagagaucggcaauggguguuucgaaacaaagcauaagugcaaccagaccugcuuagaucggauugcagccggaacuuuugacgcuggugaguucucccugccuaccuuugauucucuaaauaucacagccgcaagccucaacgacgauggccuggacaaccacaccauccuuuuguauuacucaacugccgcuaguucccuggccguuacacucaugauugcaauauucguggucuauauggugagccgugauaaugucucuuguucaaucugccuguga

SEQ ID NO: 149956 - RNA, 1758 nt, Artificial Sequence; identical to SEQ ID NO: 149955
  derived and/or modified sequence opt3 from hemagglutinin__InfluenzaB__AHL92090

SEQ ID NO: 149957 - RNA, 1758 nt, Artificial Sequence; identical to SEQ ID NO: 148530
  derived and/or modified sequence opt3 from hemagglutinin__InfluenzaB__AHL92101

SEQ ID NO: 149958 - RNA, 1755 nt, Artificial Sequence; identical to SEQ ID NO: 148583
  derived and/or modified sequence opt3 from hemagglutinin__InfluenzaB__AHL92112

SEQ ID NO: 149959 - RNA, 1758 nt, Artificial Sequence; identical to SEQ ID NO: 148530
  derived and/or modified sequence opt3 from hemagglutinin__InfluenzaB__AHL92123

SEQ ID NO: 149960 - RNA, 1758 nt, Artificial Sequence; identical to SEQ ID NO: 149955
  derived and/or modified sequence opt3 from hemagglutinin__InfluenzaB__AHL92134

SEQ ID NO: 149961 - RNA, 1758 nt, Artificial Sequence; identical to SEQ ID NO: 149955
  derived and/or modified sequence opt3 from hemagglutinin__InfluenzaB__AHL92145

SEQ ID NO: 149962 - RNA, 1758 nt, Artificial Sequence; identical to SEQ ID NO: 148530
  derived and/or modified sequence opt3 from hemagglutinin__InfluenzaB__AHL92156

SEQ ID NO: 149963 - RNA, 1758 nt, Artificial Sequence; identical to SEQ ID NO: 149955
  derived and/or modified sequence opt3 from hemagglutinin__InfluenzaB__AHL92167

SEQ ID NO: 149964 - RNA, 1758 nt, Artificial Sequence; identical to SEQ ID NO: 148530
  derived and/or modified sequence opt3 from hemagglutinin__InfluenzaB__AHL92178

SEQ ID NO: 149965 - RNA, 1758 nt, Artificial Sequence; identical to SEQ ID NO: 148530
  derived and/or modified sequence opt3 from hemagglutinin__InfluenzaB__AHL92189

SEQ ID NO: 149966 - RNA, 1755 nt, Artificial Sequence; identical to SEQ ID NO: 148583
  derived and/or modified sequence opt3 from hemagglutinin__InfluenzaB__AHL92200

SEQ ID NO: 149967 - RNA, 1758 nt, Artificial Sequence; identical to SEQ ID NO: 148530
  derived and/or modified sequence opt3 from hemagglutinin__InfluenzaB__AHL92211

SEQ ID NO: 149968 - RNA, 1758 nt, Artificial Sequence; identical to SEQ ID NO: 148530
  derived and/or modified sequence opt3 from hemagglutinin__InfluenzaB__AHL92222

SEQ ID NO: 149969 - RNA, 1755 nt, Artificial Sequence; identical to SEQ ID NO: 149845
  derived and/or modified sequence opt3 from hemagglutinin__InfluenzaB__AHL92233

SEQ ID NO: 149970 - RNA, 1758 nt, Artificial Sequence; identical to SEQ ID NO: 149955
  derived and/or modified sequence opt3 from hemagglutinin__InfluenzaB__AHL92244

SEQ ID NO: 149971 - RNA, 1758 nt, Artificial Sequence; identical to SEQ ID NO: 148530
  derived and/or modified sequence opt3 from hemagglutinin__InfluenzaB__AHL92255

SEQ ID NO: 149972 - RNA, 1758 nt, Artificial Sequence; identical to SEQ ID NO: 148530
  derived and/or modified sequence opt3 from hemagglutinin__InfluenzaB__AHL92266

SEQ ID NO: 149973 - RNA, 1758 nt, Artificial Sequence
  derived and/or modified sequence opt3 from hemagglutinin__InfluenzaB__AHL92277
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaaacagggacuauuaccuaccagagaggaauccucuuaccccagaagguguggugcgcgucugguagguccaaagucaucaagggcucacugccucuuauuggggaagcagacuguuugcaugagaaauauggaggccugaauaagagcaaaccauacuacacaggugagcacgccaaggcuauagggaacugccccaucugggugaagacuccgcuaaaacucgccaauggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgauuugaaaucuacccaggaggcuauaaacaagauuacuaagaaucucaacucccugagcgaauuagaggucaaaaaucugcagcgacucucgggggccauggacgagcuucauaacgaaauccuggaguuggaugaaaagguggacgaccuaagagcagauacgaucucuucccaaauugagcuggccguacuccugucaaaugaaggcaucauuaacagugaggacgagcaccuucuggcuuuggaaaggaaacucaagaaaaugcugggaccaagcgcgguugagauaggcaauggguguuucgaaacaaagcauaagugcaaccagaccugcuuagaucggaucgcaacuggaaccuuugacgccggugaguucucccugccuacauuugauucucuaaauauuaccgcugccagccucaacgacgauggccuggacaaccacacuauccuuuuguauuacucaacagcagccaguucccuggcugugacgcucaugaucgccauuuucgucguguauauggucagccgugauaaugugucuuguucaauaugccuguga

SEQ ID NO: 149974 - RNA, 1758 nt, Artificial Sequence; identical to SEQ ID NO: 148530
  derived and/or modified sequence opt3 from hemagglutinin__InfluenzaB__AHL92288

SEQ ID NO: 149975 - RNA, 1758 nt, Artificial Sequence; identical to SEQ ID NO: 148530
  derived and/or modified sequence opt3 from hemagglutinin__InfluenzaB__AHL92299

SEQ ID NO: 149976 - RNA, 1755 nt, Artificial Sequence; identical to SEQ ID NO: 149648
  derived and/or modified sequence opt3 from hemagglutinin__InfluenzaB__AHL92310

SEQ ID NO: 149977 - RNA, 1755 nt, Artificial Sequence; identical to SEQ ID NO: 148583
  derived and/or modified sequence opt3 from hemagglutinin__InfluenzaB__AHL92321

SEQ ID NO: 149978 - RNA, 1755 nt, Artificial Sequence; identical to SEQ ID NO: 148583
  derived and/or modified sequence opt3 from hemagglutinin__InfluenzaB__AHL92332

SEQ ID NO: 149979 - RNA, 1755 nt, Artificial Sequence
  derived and/or modified sequence opt3 from hemagglutinin__InfluenzaB__AHL92354
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaaucacgccuagcgcuaaagccuccauucuccaugaaguccgaccagugacuucuggcuguuuucccaucaugcacgaccguaccaagauaagacaacuggcaaaucuucugagggguuaugagaacauccgguugucgacacagaauguaguugaugccgaaaaggcuccugggggaccauaccgccucggcacuucaggcagcugccccaacgcaaccaguaaauccggguucuuugccacaauggcuugggccgugccuaaggacaauaacaaaaaugcgaccaacccacugacggucgaggugccguauauuuguacugaaggagaggaucagaucacagugugggguuuccauucugacaauaagacccagaugaaaaaccuguacggcgauagcaauccccaaaaguuuacuuccucagcaaacggggucacaacccacuauguuagucagauuggaggcuucccugaccagacggaggauggugggcucccacagagcggaagaaucgugguagacuacaugaugcaaaagcccggcaaaaccggcacaauaguguaucagcgcggggucuuacugccucagaagguguggugcgccucuggacgguccaaaguuauuaaggguucacuuccauugaucggcgaagcugauugucugcaugagaaauacgggggacuaaacaagagcaaacccuacuauacuggcgaacacgccaaggcaauugguaauugcccgaucugggugaagaccccucucaaacuggcuaacgggacaaaguacaggcccccagccaaacuucugaaggagcgaggcuuuuucggagcgaucgccggcuuuuuggaagggggaugggaagguaugauugcaggcuggcacggguauacuucccauggagcucacggcgucgccguggcugccgaccucaaaucuacccaggaggcaauaaauaagaucacaaagaaccugaauaguuuaagcgaacuggagguuaaaaaccuccaaagacuuucgggugccauggacgaacugcauaaugagauuuuggagcuagaugaaaagguagacgaucugagggcugacaccaucucuucccagauagagcucgcggugcugcuuucaaacgaagggauuaucaauagugaggaugaacaccuguuggcacucgagcggaaacugaagaaaauguuaggcccuagcgccgucgacaucggaaacggcuguuucgagacuaagcacaagugcaaucagacgugccuggaucguauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggugacccugaugcuugcuauauucaucgucuacauggugagccgcgacaacguuucuuguucaauuugccuguga

SEQ ID NO: 149980 - RNA, 1755 nt, Artificial Sequence; identical to SEQ ID NO: 149979
  derived and/or modified sequence opt3 from hemagglutinin__InfluenzaB__AHL92365

SEQ ID NO: 149981 - RNA, 1755 nt, Artificial Sequence; identical to SEQ ID NO: 148836
  derived and/or modified sequence opt3 from hemagglutinin__InfluenzaB__AHL92376

SEQ ID NO: 149982 - RNA, 1755 nt, Artificial Sequence; identical to SEQ ID NO: 148836
  derived and/or modified sequence opt3 from hemagglutinin__InfluenzaB__AHL92387

SEQ ID NO: 149983 - RNA, 1755 nt, Artificial Sequence; identical to SEQ ID NO: 148836
  derived and/or modified sequence opt3 from hemagglutinin__InfluenzaB__AHL92398

SEQ ID NO: 149984 - RNA, 1755 nt, Artificial Sequence; identical to SEQ ID NO: 148836
  derived and/or modified sequence opt3 from hemagglutinin__InfluenzaB__AHL92409

SEQ ID NO: 149985 - RNA, 1755 nt, Artificial Sequence; identical to SEQ ID NO: 148836
  derived and/or modified sequence opt3 from hemagglutinin__InfluenzaB__AHL92420

SEQ ID NO: 149986 - RNA, 1755 nt, Artificial Sequence; identical to SEQ ID NO: 148583
  derived and/or modified sequence opt3 from hemagglutinin__InfluenzaB__AHL92431

SEQ ID NO: 149987 - RNA, 1755 nt, Artificial Sequence; identical to SEQ ID NO: 148836
  derived and/or modified sequence opt3 from hemagglutinin__InfluenzaB__AHL92442

SEQ ID NO: 149988 - RNA, 1755 nt, Artificial Sequence; identical to SEQ ID NO: 148836
  derived and/or modified sequence opt3 from hemagglutinin__InfluenzaB__AHL92453

SEQ ID NO: 149989 - RNA, 1755 nt, Artificial Sequence; identical to SEQ ID NO: 148836
  derived and/or modified sequence opt3 from hemagglutinin__InfluenzaB__AHL92464

SEQ ID NO: 149990 - RNA, 1755 nt, Artificial Sequence
  derived and/or modified sequence opt3 from hemagglutinin__InfluenzaB__AHL92475
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaacugcauaacgagaucuuggagcuagacgaaaagguagaugaccugagggccgauacuauaucgucucagauugagcucgcuguucugcuuuccaaugaagguaucaucaacucagaggacgaacaccuguuggcgcucgagcggaaacugaagaaaauguuagggcccagugcaguggauauuggcaauggauguuucgagacgaagcacaagugcaaccaggccugccuggaccguaucgcugccggcacauuuaaugcaggggaguucagccuaccaaccuuugauucccucaacauuacugccgcuucucugaaugacgauggacuugacaaccauaccauauugcuguauuacagcacagccgcaucaagucucgcggucacccugaugcuugcuaucuucauuguguauauggucucccgcgacaaugugagcuguucuaucugccuguga

SEQ ID NO: 149991 - RNA, 1755 nt, Artificial Sequence; identical to SEQ ID NO: 148583
  derived and/or modified sequence opt3 from hemagglutinin__InfluenzaB__AHL92486

SEQ ID NO: 149992 - RNA, 1755 nt, Artificial Sequence; identical to SEQ ID NO: 148836
  derived and/or modified sequence opt3 from hemagglutinin__InfluenzaB__AHL92497

SEQ ID NO: 149993 - RNA, 1755 nt, Artificial Sequence; identical to SEQ ID NO: 148836
  derived and/or modified sequence opt3 from hemagglutinin__InfluenzaB__AHL92508

SEQ ID NO: 149994 - RNA, 1755 nt, Artificial Sequence; identical to SEQ ID NO: 148836
  derived and/or modified sequence opt3 from hemagglutinin__InfluenzaB__AHL92519

SEQ ID NO: 149995 - RNA, 1755 nt, Artificial Sequence; identical to SEQ ID NO: 148836
  derived and/or modified sequence opt3 from hemagglutinin__InfluenzaB__AHL92530

SEQ ID NO: 149996 - RNA, 1755 nt, Artificial Sequence; identical to SEQ ID NO: 148583
  derived and/or modified sequence opt3 from hemagglutinin__InfluenzaB__AHL92541

SEQ ID NO: 149997 - RNA, 1752 nt, Artificial Sequence
  derived and/or modified sequence opt3 from hemagglutinin__InfluenzaB__AHL92563
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaagaaaaguuacuucgccaaucugaaggguaccaggacucggggcaaauuguguccggauugcuuaaacuguacagaccuggauguugcgcuagggcgccccaugugcgugggaaccacgccuagcgcuaaggccuccauccuccaugaaguccgaccagugacuucuggcuguuuucccauuaugcacgaccguaccaagaucagacaacugccuaaucuucugagggguuaugagaacauacgguugucgacacagaauguaaucgaugcagaaaaagccccagggggacccuaccgccucggcacuucaggcagcugcccuaacgcuaccaguaagauuggguucuuugcaacaauggccugggcuguuccaaaagacaauuauaagaacgccaccaauccgcugacgguggagguccccuacaucuguacugaaggagaggaucagauuacagugugggguuuccauuccgacaacaaaacccagaugaagaaucuguauggcgauucuaacccucaaaaguuuacuagcuccgcgaauggggugacaacccacuacgucucacagaucggagacuucccagaucagacggaggacggcggucucccccagagugggagaauaguuguggauuauaugaugcaaaaaccuggaaagaccggcacaauuguauaccagaggggcguguuacugccacagaaagucuggugcgcaagcgggcggucuaaggugaucaaaggaucccuucccuugauuggugaagccgacugucugcaugagaaguacggcgggcuaaacaaaucaaagccguauuacacuggagaacacgcuaaggccaucggcaacugcccuaucuggguuaaaaccccucucaagcuggcaaaugguacaaaauaucgcccacccgcuaaacuucugaaagagcgaggguuuuucggcgccauugcgggauuuuuggagggcgggugggaaggaaugauagccgguuggcacggcuacacuagccauggggcacacggaguggcugucgccgcugaccucaagaguacccaggaggccaucaacaagauuacaaagaaucugaacucuuuauccgaacuggaggugaagaaucuccaaagacuuagcggcgcaauggaugaacugcauaacgagaucuuggagcuagacgaaaaaguagaugaccugagggccgauaccauaucgucucagauugagcucgcuguucugcuuuccaaugaagguaucaucaacucagaggacgaacaccuguuggcgcucgagcggaagcugaaaaagauguuagggcccagugcaguggauauuggcaauggauguuucgagacuaagcacaaaugcaaccagacgugccuggaccguaucgccgcuggcacauuuaaugccggggaguucagccuaccaaccuuugauucccucaacauuacugcagccucucugaaugacggacuugauaaccauaccauauugcuguauuacagcacagcugccucaagucucgcagucacccugaugcuugcgaucuucauuguguauauggucucccgcgacaaugugagcuguucuaucugccuguga

SEQ ID NO: 149998 - RNA, 1755 nt, Artificial Sequence; identical to SEQ ID NO: 148836
  derived and/or modified sequence opt3 from hemagglutinin__InfluenzaB__AHL92574

SEQ ID NO: 149999 - RNA, 1755 nt, Artificial Sequence
  derived and/or modified sequence opt3 from hemagglutinin__InfluenzaB__AHL92585
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggagcuacgccuagcgccaaagcauccauccuccaugaaguccgaccagugacuucuggcuguuuucccauuaugcacgaccguaccaagaucagacaacugccuaaucuucugagggguuaugagaacauacgguugucgacacagaauguaaucgaugccgaaaaggcuccagggggacccuaccgccucggcacuucaggcagcugcccuaacgcaaccaguaaauccggguucuuugccacaauggcuugggccguuccaaaggacaauaacaaaaaugcgaccaacccgcugacgguggagguccccuauauuuguacugaaggagaggaucagaucacagugugggguuuccauucugacaauaagacccagaugaaaaaccuguacggcgauagcaauccucaaaaguuuacuuccucagcaaacggggugacaacccacuaugucagucagauuggcagcuucccagaccagacggaggauggaggucucccccagucugggagaaucguuguggacuacaugaugcaaaagccuggaaaaaccggcacaauaguauaucagaggggcguguuacugccacagaaggucuggugcgccuccgggcggucaaaagugauuaagggaagccuucccuugaucggugaagcugauugucugcaugagaaauacggcgggcuaaacaagaguaaaccguacuauacuggagaacacgccaaggcaauuggcaauugcccuaucuggguuaagaccccucucaaacuggcuaacgguacaaaguaccgcccacccgccaaacuucugaaggagcgaggguuuuucggcgcgaucgccggauuuuuggagggcgggugggaaggaaugauugcagguuggcacggcuauacuucucauggggcucacggaguggccgucgcugccgaccucaaauccacccaggaggcaauaaauaagaucacaaagaaccugaauagcuuaucggaacuggaggugaaaaaccuccaaagacuuucuggcgccauggacgaacugcauaaugagauuuuggagcuagaugaaaagguagacgaucugagggcugacaccaucuccucacagauagagcucgcgguucugcuuaguaacgaagguauuaucaauagcgaggaugaacaccuguuggcacucgagcggaaacugaagaaaauguuagggcccuccgccguggagaucggcaacggauguuucgaaacuaagcacaagugcaaucagacgugccuggaccguauugcugccggcacauuuaacgcaggggaguucucucuaccaaccuuugauagccucaauaucacugccgcuucacugaacgacgauggacuugacaaucauaccauuuugcuguacuauaguacagccgcauccagccucgcggucacccugaugcuugcuauauucaucguguacauggucucucgcgauaacgugucauguaguauuugccuguga

SEQ ID NO: 150000 - RNA, 1755 nt, Artificial Sequence; identical to SEQ ID NO: 148836
  derived and/or modified sequence opt3 from hemagglutinin__InfluenzaB__AHL92596

SEQ ID NO: 150001 - RNA, 1755 nt, Artificial Sequence; identical to SEQ ID NO: 148583
  derived and/or modified sequence opt3 from hemagglutinin__InfluenzaB__AHL92607

SEQ ID NO: 150002 - RNA, 1755 nt, Artificial Sequence
  derived and/or modified sequence opt3 from hemagglutinin__InfluenzaB__AHL92629
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccagaaaagaguuacuucgccaaucugaaagguaccaggacucggggcaaguuguguccggauugcuuaaacuguacagaccuggauguugcgcuagggcgccccaugugcgugggaaccacgccuagcgcuaaagccuccauccuccaugagguccgaccagugacuucuggcuguuuucccauuaugcacgaccguaccaagaucagacaacugccuaaucuucugagggguuaugaaaacauacgguugucgacacagaauguaaucgaugcagagaaggccccagggggacccuaccgccucggcacuucaggcagcugcccuaacgcuaccaguaaaauuggguucuuugcaacaauggccugggcuguuccaaaggacaauuauaaaaacgccaccaauccgcugacgguggaaguccccuacaucuguacugagggagaggaucagauuacagugugggguuuccauuccgacaacaagacccagaugaaaaaucuguauggcgauucuaacccucaaaaguuuacuagcuccgcgaauggggugacaacccacuacgucucacagaucggagacuucccagaucagacggaagacggcggucucccccagagugggagaauaguuguggauuauaugaugcaaaagccuggaaaaaccggcacaauuguauaccagaggggcguguuacugccacagaaggucuggugcgcaagcgggcggucuaaagugaucaagggaucccuucccuugauuggugaggccgacugucugcaugaaaaauacggcgggcuaaacaagucaaaaccguauuacacuggagagcacgcuaaggccaucggcaacugcccuaucuggguuaagaccccucucaaacuggcaaaugguacaaaguaucgcccacccgcuaaacuucugaaggagcgaggguuuuucggcgccauugcgggauuuuuggaaggcgggugggagggaaugauagccgguuggcacggcuacacuagccauggggcacacggaguggcugucgccgcugaccucaaaaguacccaggaagccaucaacaagauuacaaagaaucugaacucuuuauccgagcuggaagugaaaaaucuccaaagacuuagcggcgcaauggaugagcugcauaacgagaucuuggaacuagacgagaagguagaugaccugagggccgauaccauaucgucucagauugaacucgcuguucugcuuuccaaugaggguaucaucaacucagaagacgagcaccuguuggcgcucgagcggaaacugaagaaaauguuagggcccagugcaguggauauuggcaauggauguuucgaaacuaagcacaagugcaaccagacgugccuggaccguaucgccgcuggcacauuuaaugccggggaguucagccuaccaaccuuugauucccucaacauuacugcagccucucugaaugacgauggacuugacaaccauaccauauugcuguauuacagcacagcugccucaagucucgcagucacccugaugcuugcgaucuucauuguguauauggucucccgcgacaaugugagcuguucuaucugccuguga

SEQ ID NO: 150003 - RNA, 1755 nt, Artificial Sequence; identical to SEQ ID NO: 148583
  derived and/or modified sequence opt3 from hemagglutinin__InfluenzaB__AHL92640

SEQ ID NO: 150004 - RNA, 1755 nt, Artificial Sequence; identical to SEQ ID NO: 148583
  derived and/or modified sequence opt3 from hemagglutinin__InfluenzaB__AHL92651

SEQ ID NO: 150005 - RNA, 1755 nt, Artificial Sequence
  derived and/or modified sequence opt3 from hemagglutinin__InfluenzaB__AHL92684
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauauuuguacagaaggagaggaucagaucaccgugugggguuuccauucugacaauaagacucagaugaaaaaccuguacggcgauagcaauccucaaaaguuuacauccucagcgaacggggugaccacgcacuaugucagucagauuggcagcuucccagaccagaccgaggauggaggucucccccagucugggagaaucguuguggacuacaugaugcaaaagccuggaaaaacaggcacuauaguauaucagaggggcguguuacugccacagaaggucuggugcgcauccgggcggucaaaagugauuaagggaagccuucccuugaucggugaagccgauugucugcaugagaaauacggcgggcuaaacaagaguaaaccguacuauaccggagaacacgcuaaggccauuggcaauugcccuaucuggguuaagacaccccucaaacuggcaaacgguacuaaguaccgcccuccagcuaaacuucugaaggagcgaggguuuuucggcgccaucgcgggauuuuuggagggcgggugggaaggaaugauugccgguuggcacggcuauaccucucauggggcacacggaguggcugucgccgcugaccucaaauccacacaggaggccauaaauaagaucaccaagaaccugaauagcuuaucggaacuggaggugaaaaaccuccaaagacuuucuggcgcaauggacgaacugcauaaugagauuuuggagcuagaugaaaagguagacgaucugagggccgacacuaucuccucacagauagagcucgcuguucugcuuaguaacgaagguauuaucaauagcgaggaugaacaccuguuggcgcucgagcggaaacugaagaaaauguuagggcccuccgcaguggagaucggcaacggauguuucgaaacgaagcacaagugcaaucagacaugccuggaccguauugccgcuggcaccuuuaacgccggggaguucucucuaccaacuuuugauagccucaauaucaccgcagccucacugaacgacgauggacuugacaaucauauuauauugcuguacuauaguacagcugccuccagccucgcagucacccugaugcuugcgaucuucauuguguacauggucucucgcgauaacgugucauguaguaucugccuguga

SEQ ID NO: 150006 - RNA, 1755 nt, Artificial Sequence; identical to SEQ ID NO: 148836
  derived and/or modified sequence opt3 from hemagglutinin__InfluenzaB__AHL92695

SEQ ID NO: 150007 - RNA, 1755 nt, Artificial Sequence; identical to SEQ ID NO: 148836
  derived and/or modified sequence opt3 from hemagglutinin__InfluenzaB__AHL92706

SEQ ID NO: 150008 - RNA, 1755 nt, Artificial Sequence
  derived and/or modified sequence opt3 from hemagglutinin__InfluenzaB__AHL92728
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggaaagcacgcuaaggccaucggcaacugcccuaucuggguuaaaacaccccucaagcuggcaaaugguacuaaauaucgcccuccagcuaaacuucugaaggaacgaggguuuuucggcgccauugcgggauuuuuggagggcgggugggagggaaugauagccgguuggcacggcuacaccagccauggggcacacggaguggcugucgccgcugaccucaagaguacacaggaagccaucaacaagauuaccaaaaaucugaacucuuuauccgagcuggaagugaagaaucuccaaagacuuagcggcgcaauggaugagcugcauaacgaaaucauagaguuggacgagaaaguagaugaccuaagggccgauacuauuucgucucagaucgaacuggcuguucuccuguccaaugaggguaucauuaacucagaagacgagcaccuucuggcguuggaacggaagcucaaaaagaugcuggggcccagugcaguggauaucggcaauggauguuucgagacgaagcacaaaugcaaccagacaugcuuagaccguauugccgcuggcaccuuuaaugccggggaguucagccugccaacuuuugauucccuaaacauaaccgcagccucucucaaugacgauggacuggacaaccauacaauccuuuuguauuacagcaccgcugccucaagucuggcagucacucucaugcuggcgauuuucaucguguauauggucucccgcgacaaugugagcuguucuaucugccuuuga

SEQ ID NO: 150009 - RNA, 1755 nt, Artificial Sequence; identical to SEQ ID NO: 150008
  derived and/or modified sequence opt3 from hemagglutinin__InfluenzaB__AHL92739

SEQ ID NO: 150010 - RNA, 1755 nt, Artificial Sequence; identical to SEQ ID NO: 150008
  derived and/or modified sequence opt3 from hemagglutinin__InfluenzaB__AHL92750

SEQ ID NO: 150011 - RNA, 1755 nt, Artificial Sequence; identical to SEQ ID NO: 148836
  derived and/or modified sequence opt3 from hemagglutinin__InfluenzaB__AHL92761

SEQ ID NO: 150012 - RNA, 1755 nt, Artificial Sequence
  derived and/or modified sequence opt3 from hemagglutinin__InfluenzaB__AHL92772
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcaugggaacgacuccuagcgcuaaagccuccauccuccaugaagugcgaccagucaccucuggcuguuuucccauuaugcacgaccguacaaagaucagacaacugccuaaucuucugagggguuaugagaacauacgguugucgacucagaaugugaucgaugcagaaaaggccccagggggacccuaccgccucggcaccucaggcagcugcccuaacgcuacaaguaaaauuggguucuuugcaaccauggccugggcuguaccaaaggacaauuauaaaaacgccacgaauccgcugacuguugaggugcccuacaucuguacagaaggagaggaucagauuaccgucugggguuuccauuccgacaacaagacucagaugaaaaaucuguauggcgauucuaacccucaaaaguuuacaagcuccgcgaauggggugaccacgcacuacgugucacagaucggagacuucccagaucagaccgaggacggcggucucccccagagugggagaauagucguugauuauaugaugcaaaagccuggaaaaacaggcacuauuguguaccagaggggcguauuacugccacagaagguguggugcgcaagcgggcggucuaaagucaucaagggaucccuucccuugauuggugaagccgacugucugcaugagaaauacggcgggcuaaacaagucaaaaccguauuacaccggagaacacgcuaaggccaucggcaacugcccuaucugggugaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguugcuguggccgcugaccucaaaaguacacaggaggccaucaacaagauuaccaagaaucugaacucuuuauccgaacuggaggucaaaaaucuccaaagacuuagcggcgcaauggaugaacugcauaacgagaucuuggagcuagacgaaaagguggaugaccugagggccgauacuauaucgucucagauugagcucgcuguacugcuuuccaaugaagguaucaucaacucagaggacgaacaccuguuggcgcucgagcggaaacugaagaaaauguuagggcccagugcaguugauauuggcaauggauguuucgagacgaagcacaagugcaaccagacaugccuggaccguaucgccgcuggcaccuuuaaugccggggaguucagccuaccaacuuuugauucccucaacauuaccgcagccucucugaaugacgauggacuugacaaccauacaauauugcuguauuacagcaccgcugccucaagucucgcagugacucugaugcuugcgaucuucauugucuauauggugucccgcgacaaugucagcuguucuaucugccuguga

SEQ ID NO: 150013 - RNA, 1755 nt, Artificial Sequence; identical to SEQ ID NO: 148836
  derived and/or modified sequence opt3 from hemagglutinin__InfluenzaB__AHL92794

SEQ ID NO: 150014 - RNA, 1755 nt, Artificial Sequence; identical to SEQ ID NO: 148836
  derived and/or modified sequence opt3 from hemagglutinin__InfluenzaB__AHL92805

SEQ ID NO: 150015 - RNA, 1755 nt, Artificial Sequence; identical to SEQ ID NO: 148836
  derived and/or modified sequence opt3 from hemagglutinin__InfluenzaB__AHL92816

SEQ ID NO: 150016 - RNA, 1755 nt, Artificial Sequence
  derived and/or modified sequence opt3 from hemagglutinin__InfluenzaB__AHL92827
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaacugcauaacgagaucuuggagcuagacgaaaagguagaugaccugagggccgauacuauaucgucucagauugagcucgcuguucugcuuuccaaugaagguaucaucaacucagaggacgaacaccuguuggcgcucgagcggaaacugaagaaaauguuagggcccagugcaguggauauuggcaauggauguuucgagacgaagcacaagugcaaccagacaugccuggaccguaucgccgcuggcaccuuuaaugccggggaguucagccuaccaacuuuugauucccucaacauuaccgcagccucucugaaugacgauggacuugacaaccauacaauauugcuguauuacagcaccgcugccucaagucucgcagucacucugaugcuugcgaucuucguggucuauauggugucccgcgacaauguuagcuguucuauuugccuguga

SEQ ID NO: 150017 - RNA, 1755 nt, Artificial Sequence; identical to SEQ ID NO: 148836
  derived and/or modified sequence opt3 from hemagglutinin__InfluenzaB__AHL92838

SEQ ID NO: 150018 - RNA, 1755 nt, Artificial Sequence; identical to SEQ ID NO: 148836
  derived and/or modified sequence opt3 from hemagglutinin__InfluenzaB__AHL92849

SEQ ID NO: 150019 - RNA, 1755 nt, Artificial Sequence; identical to SEQ ID NO: 148836
  derived and/or modified sequence opt3 from hemagglutinin__InfluenzaB__AHL92860

SEQ ID NO: 150020 - RNA, 1758 nt, Artificial Sequence; identical to SEQ ID NO: 148654
  derived and/or modified sequence opt3 from hemagglutinin__InfluenzaB__AHL92871

SEQ ID NO: 150021 - RNA, 1755 nt, Artificial Sequence; identical to SEQ ID NO: 148442
  derived and/or modified sequence opt3 from hemagglutinin__InfluenzaB__AHL92882

SEQ ID NO: 150022 - RNA, 1758 nt, Artificial Sequence
  derived and/or modified sequence opt3 from hemagglutinin__InfluenzaB__AHL92893
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaaggaaacucagauggcuaagcuguauggggauucuaaaccccagaaguuuacaagcuccgccaacggagugaccacgcacuacgugucacaaaucggcgguuucccuaaccagaccgaggacgggggacugccacagaguggccggauugucguugauuauauggugcagaaaagcggcaagacagggacuaucaccuaccaacgcggaauccucuuaccccagaaaguauggugcgcgucugguagauccaaggugauuaaaggcucacugccucuuauaggggaagcagacuguuugcaugagaaguauggaggccugaauaagagcaaaccauacuacacaggugagcacgccaaggcuaucgggaacugccccauuugggucaaaacuccgcuaaagcucgccaauggcaccaaauauaggccucccgcaaagcugcuuaaggaacggggauuuuucggcgcuaucgccggguuucuggagggagguugggaaggcaugauagcgggguggcauggauacacaagucacggcgcccacgguguggcaguugcugccgauuugaaaucuacccaggaggcuauuaacaagaucacuaaaaaucucaacucccugagcgaauuagaggugaagaaucugcagcgccucucgggggccauggacgagcuucauaacgaaauccuggaguuggaugaaaaagucgacgaccuacgagcagauacgauuucuucccaaaucgagcuggccgugcuccugucaaaugaaggcauuauaaacagugaggacgagcaccuucuggcuuuggaaagaaagcucaagaaaaugcugggaccaagcgcgguagagaucggcaauggguguuucgaaacaaagcauaaaugcaaccagaccugcuuagauaggauugcagccggaacuuuugacgcuggugaguucucccugccuaccuuugauucucuaaauaucacagccgcaagccucaacgacgauggccuggacaaucacaccauccuuuuguauuacucaacugccgcuaguucccuggccguuacacucaugauugcaauauucaucguguauauggucagccgggauaacgugucuuguucaauuugccuguga

SEQ ID NO: 150023 - RNA, 1755 nt, Artificial Sequence; identical to SEQ ID NO: 149039
  derived and/or modified sequence opt3 from hemagglutinin__InfluenzaB__AHL92904

SEQ ID NO: 150024 - RNA, 1758 nt, Artificial Sequence
  derived and/or modified sequence opt3 from hemagglutinin__InfluenzaB__AHL92915
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaauaucccuagcgcugaaguguccauucuccacgagguccgcccagugacuucuggcuguuuucccaucaugcaugaucgaaccaaaauacgucaacugccuaaccuucugagagguuacgaacacaucagguugucgacacauaauguaauuaacgccgagaaggcaccagggggacccuauaaaaucggcacuucaggcagcugcccuaauguuaccaacgggaauggauucuuugccacaauggcuugggcagugccaaagaacgacaauaacaaaaccgccacgaauagucucacuauugaagucccguacaucuguacagagggugaggaucagauaaccauuuggggcuuccacuccgacaacgaaacucagauggcuaagcuguauggggauucuaagccccagaaauuuacaagcuccgccaacggagugaccacgcacuacgugucacaaaucggcgguuucccuaaucagaccgaggacgggggacugccacagaguggccggauugucguugauuauauggugcaaaagagcggcaaaacagggacuaucaccuaccagcgcggaauccucuuaccccagaagguauggugcgcgucugguagauccaaagugauuaagggcucacugccucuuauaggggaagcagacuguuugcaugagaaauauggaggccugaacaagagcaagccauacuacacaggugagcacgccaaagcuaucgggaauugccccauuugggucaagacuccgcuaaaacucgccaacggcaccaaguauaggccucccgcaaaacugcuuaaggaacggggauuuuucggcgcuaucgccggguuucuggagggagguugggaaggcaugauagcgggguggcauggauacacaagucacggcgcccacgguguggcaguugcugccgauuugaagucuacccaggaggcuauuaauaaaaucacuaagaaccucaauucccugagcgaauuagaggugaaaaaccugcagcgccucucgggggccauggacgagcuucauaaugaaauccuggaguuggaugaaaaggucgacgaccuacgagcagauacgauuucuucccaaaucgagcuggccgugcuccugucaaacgaaggcauuauaaauagugaggacgagcaccuucuggcuuuggaaagaaaacucaagaagaugcugggaccaagcgcgguagagaucggcaacggguguuucgaaacaaaacauaagugcaaucagaccugcuuagauaggauugcagccggaacuuuugacgcuggugaguucucccugccuaccuuugauucucuaaacaucacagccgcaagccucaaugacgauggccuggacaaccacaccauccuuuuguauuacucaacugccgcuaguucccuggccguuacacucaugauugcaauauucaucguguauauggucagccgggauaacgugucuuguucaauuugccuguga

SEQ ID NO: 150025 - RNA, 1758 nt, Artificial Sequence; identical to SEQ ID NO: 148654
  derived and/or modified sequence opt3 from hemagglutinin__InfluenzaB__AHL92926

SEQ ID NO: 150026 - RNA, 1755 nt, Artificial Sequence; identical to SEQ ID NO: 149615
  derived and/or modified sequence opt3 from hemagglutinin__InfluenzaB__AHL92937

SEQ ID NO: 150027 - RNA, 1758 nt, Artificial Sequence; identical to SEQ ID NO: 148530
  derived and/or modified sequence opt3 from hemagglutinin__InfluenzaB__AHL92948

SEQ ID NO: 150028 - RNA, 1758 nt, Artificial Sequence; identical to SEQ ID NO: 148530
  derived and/or modified sequence opt3 from hemagglutinin__InfluenzaB__AHL92959

SEQ ID NO: 150029 - RNA, 1758 nt, Artificial Sequence; identical to SEQ ID NO: 148530
  derived and/or modified sequence opt3 from hemagglutinin__InfluenzaB__AHL92970

SEQ ID NO: 150030 - RNA, 1758 nt, Artificial Sequence; identical to SEQ ID NO: 148530
  derived and/or modified sequence opt3 from hemagglutinin__InfluenzaB__AHL92981

SEQ ID NO: 150031 - RNA, 1758 nt, Artificial Sequence; identical to SEQ ID NO: 148530
  derived and/or modified sequence opt3 from hemagglutinin__InfluenzaB__AHL92992

SEQ ID NO: 150032 - RNA, 1758 nt, Artificial Sequence; identical to SEQ ID NO: 149955
  derived and/or modified sequence opt3 from hemagglutinin__InfluenzaB__AHL93004

SEQ ID NO: 150033 - RNA, 1758 nt, Artificial Sequence; identical to SEQ ID NO: 148530
  derived and/or modified sequence opt3 from hemagglutinin__InfluenzaB__AHL93015

SEQ ID NO: 150034 - RNA, 1758 nt, Artificial Sequence; identical to SEQ ID NO: 148530
  derived and/or modified sequence opt3 from hemagglutinin__InfluenzaB__AHL93026

SEQ ID NO: 150035 - RNA, 1755 nt, Artificial Sequence; identical to SEQ ID NO: 149979
  derived and/or modified sequence opt3 from hemagglutinin__InfluenzaB__AHL93037

SEQ ID NO: 150036 - RNA, 1755 nt, Artificial Sequence; identical to SEQ ID NO: 149979
  derived and/or modified sequence opt3 from hemagglutinin__InfluenzaB__AHL93048

SEQ ID NO: 150037 - RNA, 1755 nt, Artificial Sequence; identical to SEQ ID NO: 150008
  derived and/or modified sequence opt3 from hemagglutinin__InfluenzaB__AHL93059

SEQ ID NO: 150038 - RNA, 1755 nt, Artificial Sequence; identical to SEQ ID NO: 148836
  derived and/or modified sequence opt3 from hemagglutinin__InfluenzaB__AHL93070

SEQ ID NO: 150039 - RNA, 1755 nt, Artificial Sequence
  derived and/or modified sequence opt3 from hemagglutinin__InfluenzaB__AHL93081
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaacugcauaacgagaucuuggagcuagacgguaagguagaugaccugagggccgauacuauaucgucucagauugaacucgcuguucugcuuuccaaugaggggaucaucaacucagaagacgagcaccuguuggcgcucgaacggaaacugaagaaaauguuaggccccagugcaguggauauuggaaauggcuguuucgagacgaagcacaagugcaaccagacaugccuggaccguaucgccgcugggaccuuuaaugccggagaguucagccuaccaacuuuugauucccucaacauuaccgcagccucucugaaugacgauggucuugacaaccauacaauauugcuguauuacagcaccgcugccucaagucucgcagucacucugaugcuugcgaucuucauuguguauauggucucccgcgacaaugugagcuguucuaucugccuguga

SEQ ID NO: 150040 - RNA, 1755 nt, Artificial Sequence; identical to SEQ ID NO: 148836
  derived and/or modified sequence opt3 from hemagglutinin__InfluenzaB__AHL93092

SEQ ID NO: 150041 - RNA, 1755 nt, Artificial Sequence; identical to SEQ ID NO: 148836
  derived and/or modified sequence opt3 from hemagglutinin__InfluenzaB__AHL93103

SEQ ID NO: 150042 - RNA, 1755 nt, Artificial Sequence; identical to SEQ ID NO: 148836
  derived and/or modified sequence opt3 from hemagglutinin__InfluenzaB__AHL93114

SEQ ID NO: 150043 - RNA, 1755 nt, Artificial Sequence; identical to SEQ ID NO: 148583
  derived and/or modified sequence opt3 from hemagglutinin__InfluenzaB__AHL93125

SEQ ID NO: 150044 - RNA, 1755 nt, Artificial Sequence
  derived and/or modified sequence opt3 from hemagglutinin__InfluenzaB__AHL93136
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagcgggucuggugcgcaagcgggcgcucuaaggugaucaaaggaucccuucccuugauuggugaagccgacugucugcaugagaaguacggcgggcuaaacaaaucaaagccguauuacaccggagaacacgcuaaagccaucggcaacugcccuaucuggguuaagacaccccucaagcuggcaaaugguacuaaauaucgaccuccagcuaaacuucugaaggagagaggguuuuucggcgccauugcgggauuuuuggagggcgggugggaaggaaugauagccgguuggcacggcuacaccagccauggggcacacggaguggcugucgccgcugaccucaagaguacacaggaggccaucaacaaaauuaccaagaaucugaacucuuuauccgaacuggaggugaagaaucuccaaaggcuuagcggcgcaauggaugaacugcauaacgagaucuuggagcuagacgaaaaaguagaugaccugcgggccgauacuauaucgucucagauugagcucgcuguucugcuuuccaaugaagguaucaucaacucagaggacgaacaccuguuggcgcucgagcguaagcugaaaaagauguuagggcccagugcaguggauauuggcaauggauguuucgagacgaaacacaagugcaaccagacaugccuggaccgcaucgccgcuggcaccuuuaaugccggggaguucagccuaccaacuuuugauucccucaacauuaccgcagccucucugaaugacgauggacuugacaaccauacaauauugcuguauuacagcaccgcugccucaagucucgcagucacucugaugcuugcgaucuucauuguguauauggucuccagagacaaugugagcuguucuaucugccuguga

SEQ ID NO: 150045 - RNA, 1755 nt, Artificial Sequence; identical to SEQ ID NO: 148583
  derived and/or modified sequence opt3 from hemagglutinin__InfluenzaB__AHL93147

SEQ ID NO: 150046 - RNA, 1755 nt, Artificial Sequence; identical to SEQ ID NO: 148836
  derived and/or modified sequence opt3 from hemagglutinin__InfluenzaB__AHL93158

SEQ ID NO: 150047 - RNA, 1755 nt, Artificial Sequence
  derived and/or modified sequence opt3 from hemagglutinin__InfluenzaB__AHL93169
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuuaacuguaccgacuuagauguugcgcuggggcgccccaugugcgugggaacgacuccuagcgcuaaagccuccauccuacaugaaguccgaccagugaccucuggcuguuuccccauuaugcacgaccguacaaagaucagacaacucccuaaucugcuuagggguuaugagaacauacggcugucgacucagaauguaaucgaugcagaaaaggccccagggggacccuaccgcuugggcaccucaggcagcugcccuaacgcuacaaguaaaauuggguuuuucgcaaccauggccugggcuguuccaaaggacaauuauaaaaacgccacgaauccgcucacuguggagguccccuacaucuguacagaaggagaggaucagauuaccgugugggguuuucauuccgacaacaagacucagaugaaaaaucuguauggcgauucuaacccucaaaaguucacaagcuccgcgaauggggugaccacgcacuacgucucacagaucggagacuuuccagaucagaccgaggacggcggucugccccagagugggagaauaguuguggauuauaugaugcaaaagccuggaaaaacaggcacuauuguauaccagaggggcgugcucuuaccacagaaggucuggugcgcaagcgggcggucuaaagugaucaagggaucccugccccuuauuggugaagccgacuguuugcaugagaaauacggcgggcugaacaagucaaaaccguauuacaccggagaacacgcuaaggccaucggcaacugcccuaucuggguuaagacaccccuaaaacucgcaaaugguacuaaguaucgcccuccagcuaaacugcuuaaggagcgaggguucuuuggcgccauugcgggauuccuggagggcgggugggaaggaaugauagccgguuggcacggcuacaccagccauggggcacacggaguggcugucgccgcugacuugaaaaguacacaggaggccaucaacaagauuaccaagaaucucaacucucuguccgaauuagaggugaaaaaucugcaaagacucagcggcgcaauggaugaacuucauaacgagauccuggaguuggacgaaaagguagaugaccuaagggccgauacuauaucgucucagauugagcuggcuguucuccuguccaaugaagguaucaucaacucagaggacgaacaccuucuggcguuggagcggaaacucaagaaaaugcuggggcccagugcaguggauauuggcaauggauguuuugagacgaagcacaagugcaaccagacaugcuuagaccguaucgccgcuggcaccuucaaugccggggaauuuagccugccaacuuucgauucccuaaacauuaccgcagccucucucaaugacgauggacuggacaaccauacaauacuuuuguauuacagcaccgcugccucaagucuggcagucacucucaugcuggcgaucuucauuguguauauggucucccgcgacaaugugagcuguucuaucugccuuuga

SEQ ID NO: 150048 - RNA, 1755 nt, Artificial Sequence
  derived and/or modified sequence opt3 from hemagglutinin__InfluenzaB__AHL93180
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuauccacgaccguacaaagauaagacaacugccuaaucuucugagggguuaugagaacauccgguugucgacucagaauguaauugaugcagaaaaggccccagggggacccuaccgccucggcaccucaggcagcugcccuaacgcuacaaguaaauccggguucuuugcaaccauggccugggcuguuccaaaggacaauaacaaaaaugccacgaacccgcugacuguggagguccccuauaucuguacagaaggagaggaucagauuaccgugugggguuuccauucugacaauaagacucagaugaaaaaccuguacggcgauagcaauccucaaaaguuuacauccucagcgaacggggugaccacgcacuaugucagucagaucggcagcuucccagaccagaccgaggauggaggucucccccagucugggagaauaguuguggacuacaugaugcaaaagccuggaaaaacaggcacuauuguauaucagaggggcguguuacugccacagcgggucuggugcgcauccgggcgcucaaaggugaucaaaggaagccuucccuugauuggugaagccgauugucugcaugagaaguacggcgggcuaaacaaaaguaagccguacuauaccggagaacacgcuaaagccaucggcaauugcccuaucuggguuaagacaccccucaagcuggcaaacgguacuaaauaccgaccuccagcuaaacuucugaaggagagaggguuuuucggcgccauugcgggauuuuuggagggcgggugggaaggaaugauagccgguuggcacggcuauaccucucauggggcacacggaguggcugucgccgcugaccucaaguccacacaggaggccaucaauaaaauuaccaagaaccugaauagcuuaucggaacuggaggugaagaaccuccaaaggcuuucuggcgcaauggacgaacugcauaaugagaucuuggagcuagaugaaaaaguagacgaucugcgggccgacacuauauccucacagauugagcucgcuguucugcuuaguaacgaagguaucaucaauagcgaggaugaacaccuguuggcgcucgagcguaagcugaaaaagauguuagggcccuccgcaguggagauuggcaacggauguuucgaaacgaaacacaagugcaaucagacaugccuggaccgcaucgccgcuggcaccuuuaacgccggggaguucucucuaccaacuuuugauagccucaauauuaccgcagccucacugaacgacgauggacuugacaaucauacaauauugcuguacuauaguaccgcugccuccagccucgcagucacucugaugcuugcgaucuucauuguguacauggucucuagagauaacgugucauguaguaucugccuguga

SEQ ID NO: 150049 - RNA, 1755 nt, Artificial Sequence
  derived and/or modified sequence opt3 from hemagglutinin__InfluenzaB__AHL93191
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgacacaaguaaaauuggguucuuugcuaccauggcaugggccguuccaaaggauaauuauaaaaacgcuacgaauccgcugacuguggagguccccuacaucuguacagaaggagaggaccagauuaccgugugggguuuccauuccgauaacaagacucagaugaaaaaucuguauggcgacucuaacccucaaaaguuuacaagcuccgccaauggggugaccacgcacuacgucucacagaucggagauuucccagaccagaccgaggauggcggucucccccagagugggagaauaguuguggacuauaugaugcaaaagccuggaaaaacaggcacuauuguauaccagaggggcguguuacugccacagaaggucuggugcgcgagcgggcggucuaaagugaucaagggaucccuucccuugauuggugaagcagacugucugcaugagaaauacggcgggcuaaacaagucaaaaccguauuacaccggagaacacgccaaggcuaucggcaacugcccuaucuggguuaagacaccccucaaacuggccaaugguacuaaguaucgcccuccagcaaaacuucugaaggagcgaggguuuuucggcgcuauugccggauuuuuggagggcgggugggaaggaaugauagcggguuggcacggcuacaccagccauggggcccacggaguggcagucgcugccgaucucaaaaguacacaggaggcuaucaacaagauuaccaagaaucugaacucuuuauccgaacuggaggugaaaaaucuccaaagacuuagcggcgccauggacgaacugcauaacgagaucuuggagcuagaugaaaagguagacgaucugagggcagacacuauaucgucucagauugagcucgccguucugcuuuccaaugaagguaucaucaacucagaggaugaacaccuguuggcucucgagcggaaacugaagaaaauguuagggcccagugcgguggacauuggcaauggauguuucgagacgaagcacaagugcaaccagacaugccuggaucguaucgcagccggcaccuuuaaugcuggggaguucagccuaccaacuuuugacucccucaacauuaccgccgcaucucugaaugaugacggacuugacaaccauacaauauugcuguauuacagcaccgccgcuucaagucucgccgucacucugaugcuugcaaucuucauuguguauauggucucccgcgauaaugugagcuguucuaucugccuguga

SEQ ID NO: 150050 - RNA, 1755 nt, Artificial Sequence
  derived and/or modified sequence opt3 from hemagglutinin__InfluenzaB__AHL93202
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugaugcaaaagccuggaaaaacaggcacuauuguauaccagaggggcguguuacugccacagaaggucuggugcgcaagcgggcggucuaaagugaucaagggaucccuucccuugauuggugaagccgacugucugcaugagaaauacggcgggcuaaacaagucaaaaccguauuacaccggagaacacgcuaaggccaucggcaacugcccuaucuggguuaagacaccccucaaacuggcaaaugguacuaaguaucgcccuccagcuaaacuucugaaggagcgaggguuuuucggcgccauugcgggauuuuuggagggcgggugggaaggaaugauagccgguuggcacggcuacaccagccauggggcacacggaguggcugucgccgcugaccucaaaaguacacaggaggccaucaacaagauuaccaagaaucugaacucuuuauccgaacuggaggugaaaaaucuccaaagacuuagcggcgcaauggaugaguuccauaacgaaauccuggaguuggacgaaaagguagaugaccuaagggccgauacuauaucgucucagauugagcuggcuguucuccuguccaaugaagguaucaucaacucagaggacgaacaccuucuggcguuggagcggaaacucaagaaaaugcuggggcccagugcaguggauauuggcaauggauguuuugagacgaagcacaagugcaaccagacaugcuuagaccguaucgccgcuggcaccuucaaugccggggaauuuagccugccaacuuucgauucccuaaacauuaccgcagccucucucaaugacgauggacuggacaaccauacaauacuuuuguauuacagcaccgcugccucaagucuggcagucacucucaugcuggcgaucuucauuguguauauggucucccgcgacaaugugagcuguucuaucugccuuuga

SEQ ID NO: 150051 - RNA, 1758 nt, Artificial Sequence; identical to SEQ ID NO: 149005
  derived and/or modified sequence opt3 from hemagglutinin__InfluenzaB__AHL93213

SEQ ID NO: 150052 - RNA, 1758 nt, Artificial Sequence; identical to SEQ ID NO: 149005
  derived and/or modified sequence opt3 from hemagglutinin__InfluenzaB__AHL93224

SEQ ID NO: 150053 - RNA, 1758 nt, Artificial Sequence
  derived and/or modified sequence opt3 from hemagglutinin__InfluenzaB__AHL93235
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaacaaaauuacuaagaauuugaacucucucuccgaacuggaggucaaaaauuuacagcgacugagcggggccauggacgagcuccauaacgaaauccuugagcuggaugaaaagguggacgacuugagagcagauacgaucucgucucaaauugagcuagccguacugcucuccaaugaaggcaucauuaacucagaggacgagcaucugcuugcucuggaaaggaaauugaagaagaugcucggacccagugcgguugagauaggcaauggguguuucgaaacaaaacacaagugcaaccagaccugccuggaucggaucgcagccggaacuuuugacgcuggugaguucagcuuaccaaccuuugauucccugaauauuacagccgcaucucuaaacaaugacggccucgauaaccacaccauccugcuuuauuacagcacugccgcuucaaguuuggccgugacacugaugaucgcaauuuucgucguguauauggucucccgugacaacgugagcuguucuauaugccucuga

SEQ ID NO: 150054 - RNA, 1758 nt, Artificial Sequence
  derived and/or modified sequence opt3 from hemagglutinin__InfluenzaB__AHL93246
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaaaaacaagaccgccacgaauagucucacuauugaagucccguacaucuguacagagggugaggaucagauaaccauuuggggcuuccacuccgacaacgaaacucagauggcuaaacuguauggggauucuaagccccagaaguuuacaagcuccgccaacggagugaccacgcacuacgugucacaaaucggcgguuucccuaaucagaccgaggacgggggacugccacagaguggccgcauugucguugauuauauggugcagaaaagcggcaagacagggacuaucaccuaccaaagaggaauccucuuaccccagaaaguauggugcgcgucugguagguccaaggugauuaaaggcucacugccucuuauaggggaagcagacuguuugcaugagaaguauggaggccugaacaaaagcaagccauacuacacaggugagcacgccaaggcuaucgggaauugccccauuugggucaaaacuccgcuaaagcucgccaacggcaccaaauaucggccucccgcaaagcugcuuaaagaacgcggauuuuucggcgcuaucgccggguuucuggagggagguugggaaggcaugauagcgggguggcauggauacacaagucacggcgcccacgguguggcaguugcugccgauuugaagucuacccaggaggcuauuaauaagaucacuaaaaaccucaauucccugggggaauuagaggugaagaaccugcagcgacucagcggcgccauggacgagcuucauaaugaaauccuggaguuggaugaaaaagucgacgaccuaagagcagauacgauuucgucucaaaucgagcuggccgugcuccuguccaacgaaggaauuauaaauucagaggacgagcaccuucuggcuuuggaaaggaagcucaaaaagaugcugggcccaagugcgguagagaucgggaacggauguuucgaaacaaagcauaaaugcaaucagaccugcuuagaucggauugcagccgguacuuuugacgcuggcgaguucagccugccuaccuuugauucccuaaacaucacagccgcaucucucaaugacgaugggcuggacaaccacaccauccuuuuguauuacagcacugccgcuucaagucuggccguuacacucaugauugcaauauucguggucuauauggugucccgugauaacgucagcuguucuaucugccuguga

SEQ ID NO: 150055 - RNA, 1758 nt, Artificial Sequence; identical to SEQ ID NO: 149005
  derived and/or modified sequence opt3 from hemagglutinin__InfluenzaB__AHL93257

SEQ ID NO: 150056 - RNA, 1758 nt, Artificial Sequence; identical to SEQ ID NO: 149338
  derived and/or modified sequence opt3 from hemagglutinin__InfluenzaB__AHL93268

SEQ ID NO: 150057 - RNA, 1758 nt, Artificial Sequence
  derived and/or modified sequence opt3 from hemagglutinin__InfluenzaB__AHL93279
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaaaucuaaggugauuaaaggcucccugccacuuauaggggaagcagacuguuugcaugagaaguauggaggccugaauaagucaaaacccuacuacacaggugagcacgccaaggcuaucgggaacugcccgauuugggucaaaacuccucuaaagcucgccaauggcaccaaauauaggcccccagcaaagcugcuuaaggaacggggauuuuucggcgcuaucgccggguuucuggagggagguugggaaggcaugauagcgggguggcauggauacacaagccacggcgcccacgguguggcaguugcugccgauuugaaaaguacccaggaggcuauuaacaagaucacuaaaaaucucaacucucuguccgaauuagaggugaagaaucugcagcgccucagcggggccauggacgagcuucauaacgaaauccuggaguuggaugaaaaagucgacgaccuacgagcagauacgauuucgucucaaaucgagcuggccgugcuccuguccaaugaaggcauuauaaacucagaggacgagcaccuucuggcuuuggaaagaaagcucaagaaaaugcugggaccuagugcgguagagaucggcaauggguguuucgaaacaaagcauaaaugcaaccagaccugcuuagauaggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgggauaacgucagcuguucuaucugccuguga

SEQ ID NO: 150058 - RNA, 1758 nt, Artificial Sequence; identical to SEQ ID NO: 149005
  derived and/or modified sequence opt3 from hemagglutinin__InfluenzaB__AHL93290

SEQ ID NO: 150059 - RNA, 1758 nt, Artificial Sequence
  derived and/or modified sequence opt3 from hemagglutinin__InfluenzaB__AHL93301
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuuaaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaacgucagcuguucuaucugccuguga

SEQ ID NO: 150060 - RNA, 1758 nt, Artificial Sequence
  derived and/or modified sequence opt3 from hemagglutinin__InfluenzaB__AHL93312
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuacgccacaauggcuugggcaguuccgaaaaacgacaagaauaaaaccgccacgaacccacucacuaucgaagugcccuauauauguacagagggugaggaucagauuaccgucuggggcuuucacagugacaaugaaacucagauggcuaagcuguacggggauuccaagccucagaaauucacaucuagcgccaacggagugaccacgcacuaugugucccaaaucggcgguuuuccaaaccagaccgaggacgggggacugccccagucaggccgcauugucguugauuacauggugcagaagaguggcaaaacagggacuaucaccuaucaaagaggaauccucuuaccucagaagguauggugcgcgagcgguaggucuaaagugauuaagggcucccugccacuuauaggggaagcagacuguuugcaugagaaauacggaggccugaauaagucaaagcccuacuauacaggugagcacgccaaagcuaucgggaacugcccgauuugggucaagacuccucuaaaacucgccaauggcaccaaguaccggcccccagcaaaacugcuuaaggaacgcggauucuuuggcgcuaucgccggguuccuggagggagguugggaaggcaugauagcgggguggcauggauauacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuuugaaacaaaacauaagugcaaccagaccugcuuagaucggauugcagccggaacuuucgacgcuggugaguuuagccugcccaccuucgauucccuaaauaucacagccgcaucucucaacgacgauggccuggacaaucacaccauccuuuuguacuauagcacugccgcuucaagucuggccguuacacucaugauugcaauauuuguggucuacauggugucccgugauaacgucagcuguucuaucugccuguga

SEQ ID NO: 150061 - RNA, 1758 nt, Artificial Sequence
  derived and/or modified sequence opt3 from hemagglutinin__InfluenzaB__AHL93323
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcacaagcgguaggucuaaagugauuaagggcucccugccacuuauaggggaagcggacuguuugcaugagaaauauggaggccugaauaagucaaagcccuacuacacuggugagcacgcaaaagccaucgggaacugcccgauuugggucaagaccccucuaaaacucgcuaauggcacaaaguaucggcccccagccaaacugcuuaaggaacgcggauuuuucggcgcaaucgcuggguuucuggagggagguugggaaggcaugauagccggguggcauggauacaccagccacggcgcgcacgguguggccguugcagcugauuugaagaguacucaggaggccauuaacaaaaucacgaagaaucucaacucucuguccgaauuagaggugaaaaaucugcagcgacucagcggggcuauggacgagcuucauaacgaaauccuggaguuggaugaaaaggucgacgaccuaagagccgauacaauuucgucucaaaucgagcuggcagugcuccuguccaaugaaggcauuauaaacucagaggacgagcaccuucuggccuuggaaaggaaacucaagaagaugcugggaccuagugcuguagagaucggcaauggguguuucgaaaccaaacauaagugcaaccagacuugcuuagaucggauugcggcaggaaccuuugacgccggugaguucagccugcccacauuugauucccuaaauaucaccgcugccucucucaacgacgauggccuggacaaucacacuauccuuuuguauuacagcacagcagccucaagucuggcuguuacgcucaugauugccauauucguggucuauauggugucccgugauaacgucagcuguucuaucugccuguga

SEQ ID NO: 150062 - RNA, 1758 nt, Artificial Sequence
  derived and/or modified sequence opt3 from hemagglutinin__InfluenzaB__AHL93334
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauauuaccaacgggaauggauucuuugccacaauggcuugggcaguuccgaaaaacgacaagaauaaaaccgccacgaaccccuugacuaucgaagugccuuacauauguacagagggugaggaucagauuaccgucuggggcuuccacagugacaaugaaacucagauggcuaagcucuauggggauuccaagccacagaaauuuacaucuagcgccaacggagugaccacgcacuacgugucccaaaucggcgguuuccccaaccagaccgaggacgggggacugccucagucaggccgcauugucguugauuauauggugcagaagaguggcaaaacagggacuaucaccuaccaaagaggaauccugcucccacagaagguauggugcacaagcgguaggucuaaagugauuaagggcuccuuaccccugauaggggaagcggacugucuucaugagaaauauggaggcuugaauaagucaaagccguacuacacuggugagcacgcaaaagccaucgggaacugcccuauuugggucaagaccccacugaaacuagcuaauggcacaaaguaucggcccccugccaaacuccugaaggaacgcggauuuuucggcgcaaucgcuggguuucuugagggagguugggaaggcaugauagccggguggcauggauacaccagccacggcgcgcacgguguggccguugcagcugaucugaagaguacucaggaggccauuaacaaaaucacgaagaauuugaacucucucuccgaacuggaggugaaaaauuuacagcgacugagcggggcuauggacgagcuccauaacgaaauccuugagcuggaugaaaaggucgacgacuugagagccgauacaauuucgucucaaaucgagcuagcagugcugcucuccaaugaaggcauuauaaacucagaggacgagcaucugcuugcccuggaaaggaaauugaagaagaugcucggacccagugcuguagagaucggcaauggguguuucgaaaccaaacacaagugcaaccagacuugccuggaucggauugcggcaggaaccuuugacgccggugaguucagcuuaccaacauuugauucccugaauaucaccgcugccucucuaaacgacgauggccucgacaaucacacuauccugcuuuauuacagcacagcagccucaaguuuggcuguuacgcugaugauugccauauucguggucuauauggugucccgugauaacgucagcuguucuaucugccucuga

SEQ ID NO: 150063 - RNA, 1758 nt, Artificial Sequence; identical to SEQ ID NO: 149005
  derived and/or modified sequence opt3 from hemagglutinin__InfluenzaB__AHL93345

SEQ ID NO: 150064 - RNA, 1758 nt, Artificial Sequence; identical to SEQ ID NO: 149005
  derived and/or modified sequence opt3 from hemagglutinin__InfluenzaB__AHL93356

SEQ ID NO: 150065 - RNA, 1758 nt, Artificial Sequence
  derived and/or modified sequence opt3 from hemagglutinin__InfluenzaB__AHL93367
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaauauauccgguugucgacacacaacguaauuaaugccgagaacgcaccagggggacccuacaagaucggcacuucaggcagcugcccuaauauuaccaacgggaauggauucuuugccacaauggcuugggcaguuccgaaaaacgacaagaauaaaaccgccacgaacccacucacuaucgaagugcccuauauauguacagagggugaggaucagauuaccgucuggggcuuccauagugacaaugaaacucagauggcuaagcuguacggggauuccaagccucagaaauuuacaucuagcgccaacggagugaccacgcacuaugugucccaaaucggcgguuucccaaaccagaccgaggacgggggacugccccagucaggccgcauugucguugauuacauggugcagaagaguggcaaaacagggacuaucaccuaucaaagaggaauccucuuaccucagaagguauggugcgcgagcgguaggucuaaagugauuaagggcucccugccacuuauaggggaagcagacuguuugcacgagaaauacggaggccugaauaagucaaagcccuacuauacaggugagcaugccaaagcuaucgggaacugcccgauuugggucaagacuccucuaaaacucgccaauggcaccaaguaccggcccccagcaaaacugcuuaaggaacgcggauuuuucggcgcuaucgccggguuucuggagggagguugggaaggcaugauagcgggguggcacggauauacaagccauggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucacaacgaaauccuggaguuggaugaaaaggucgacgaccuaagagcagauacgauuucgucucaaaucgagcuggccgugcuccuguccaaugaaggcauuauaaacucagaggacgagcaucuucuggcuuuggaaaggaaacucaagaagaugcugggaccuagugcgguagagaucggcaauggguguuucgaaacaaaacacaagugcaaccagaccugcuuagaucggauugcagccggaacuuuugacgcuggugaguucagccugcccaccuuugauucccuaaauaucacagccgcaucucucaacgacgauggccuggacaaucauaccauccuuuuguacuauagcacugccgcuucaagucuggccguuacacucaugauugcaauauucguggucuacauggugucccgugauaacgucagcuguucuaucugccuguga

SEQ ID NO: 150066 - RNA, 1758 nt, Artificial Sequence; identical to SEQ ID NO: 149005
  derived and/or modified sequence opt3 from hemagglutinin__InfluenzaB__AHL93378

SEQ ID NO: 150067 - RNA, 1758 nt, Artificial Sequence
  derived and/or modified sequence opt3 from hemagglutinin__InfluenzaB__AHL93389
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccaugagguccgaccagugacuucuggcuguuuucccaucaugcacgaucguaccaaaauaagacaacugccuaaucuucugagggguuaugaacauauccgguugucgacacacaacguaauuaaugccgagaacgcaccagggggacccuacaagaucggcacuucaggcagcugcccuaauauuaccaacgggaauggauucuuugccacaauggcuugggcaguuccgaaaaacgacaagaauaaaaccgccacgaacccacucacuaucgaagugcccuauauauguacagagggugaggaucagauuaccgucuggggcuuccauagugacaaugaaacucagauggcuaagcuguacggggauuccaagccucagaaauuuacaucuagcgccaacggagugaccacgcacuaugugucccaaaucggcgguuucccaaaccagaccgaggacgggggacugccccagucaggccgcauugucguugauuacauggugcagaagaguggcaaaacagggacuaucaccuaucaaagaggaauccucuuaccucagaagguauggugcgcgagcgguaggucuaaagugauuaagggcucccugccacuuauaggggaagcagacuguuugcacgagaaauacggaggccugaauaagucaaagcccuacuauacaggugagcaugccaaagcuaucgggaacugcccgauuugggucaagacuccucuaaaacucgccaauggcaccaaguaccggcccccagcaaaacugcuuaaggaacgcggauuuuucggcgcuaucgccggguuucuggagggagguugggaaggcaugauagcgggguggcacggauauacaagccauggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucacaacgaaauccuggaguuggaugaaaaggucgacgaccuaagagcagauacgauuucgucucaaaucgagcuggccgugcuccuguccaaugaaggcauuauaaacucagaggacgagcaucuucuggcuuuggaaaggaaacucaagaagaugcugggaccuagugcgguagagaucggcaauggguguuucgaaacaaaacacaagugcaaccagaccugcuuagaucggauugcagccggaacuuuugacgcuggugaguucagccugcccaccuuugauucccuaaauaucacagccgcaucucucaacgacgauggccuggacaaucauaccauccuuuuguacuauagcacugccgcuucaagucuggccguuacacucaugauugcaauauucguggucuacauggugucccgugauaacgucagcuguucuaucugccuguga

SEQ ID NO: 150068 - RNA, 1758 nt, Artificial Sequence; identical to SEQ ID NO: 149005
  derived and/or modified sequence opt3 from hemagglutinin__InfluenzaB__AHL93400

SEQ ID NO: 150069 - RNA, 1758 nt, Artificial Sequence; identical to SEQ ID NO: 149338
  derived and/or modified sequence opt3 from hemagglutinin__InfluenzaB__AHL93411

SEQ ID NO: 150070 - RNA, 1758 nt, Artificial Sequence; identical to SEQ ID NO: 149338
  derived and/or modified sequence opt3 from hemagglutinin__InfluenzaB__AHL93422

SEQ ID NO: 150071 - RNA, 1758 nt, Artificial Sequence; identical to SEQ ID NO: 149338
  derived and/or modified sequence opt3 from hemagglutinin__InfluenzaB__AHL93433

SEQ ID NO: 150072 - RNA, 1758 nt, Artificial Sequence; identical to SEQ ID NO: 149005
  derived and/or modified sequence opt3 from hemagglutinin__InfluenzaB__AHL93444

SEQ ID NO: 150073 - RNA, 1758 nt, Artificial Sequence
  derived and/or modified sequence opt3 from hemagglutinin__InfluenzaB__AHL93455
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccaugaacgagcuucauaaugaaauccuggaguuggacgaaaaggucgaugaccuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaacgucagcuguucuaucugccuguga

SEQ ID NO: 150074 - RNA, 1758 nt, Artificial Sequence; identical to SEQ ID NO: 149005
  derived and/or modified sequence opt3 from hemagglutinin__InfluenzaB__AHL93466

SEQ ID NO: 150075 - RNA, 1758 nt, Artificial Sequence; identical to SEQ ID NO: 148624
  derived and/or modified sequence opt3 from hemagglutinin__InfluenzaB__AHL93477

SEQ ID NO: 150076 - RNA, 1758 nt, Artificial Sequence; identical to SEQ ID NO: 148699
  derived and/or modified sequence opt3 from hemagglutinin__InfluenzaB__AHL93488

SEQ ID NO: 150077 - RNA, 1755 nt, Artificial Sequence
  derived and/or modified sequence opt3 from hemagglutinin__InfluenzaB__AHL93499
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaauucgaccagucaccucuggcuguuuucccaucaugcacgaccguacaaagauaagacaacugccuaaucuucugagggguuaugagaacauccgguugucgacucagaaugugauugaugcagaaaaggccccagggggacccuaccgccucggcaccucaggcagcugcccuaacgcuacaaguaaaaucggguucuuugcaaccauggccugggcuguaccaaaggacaauuauaaaaacgccacgaauccgcugacuguugaggugcccuacauuuguacagaaggagaggaucagaucaccgucugggguuuccauuccgacaacaagacucagaugaaaaaucuguauggcgauucuaacccucaaaaguuuacaagcuccgcgaauggggugaccgcacacuacgugucacagauaggagacuucccagaucagacggaggacggcggucucccccagagugggagaauugucguugauuauaugaugcaaaagccuggaaaaaccggcacaaucguguaccagaggggcguauuacugccacagaagguguggugcgccagcgggcggucuaaagucauuaagggaucccuucccuugaucggugaagcugacugucugcaugagaaauacggcgggcuaaacaagucaaaaccguauuacacuggagaacacgccaaggcaaucggcaacugcccuauuugggugaagaccccucucaaacuggcuaaugguacaaaguaucgcccacccgccaaacuucugaaggagcgaggguuuuucggcgcgauagccggauuuuuggagggcgggugggaaggaaugaucgcagguuggcacggcuacacuagccauggggcucacggaguugccguggcugccgaccucaaaaguacccaggaggcaauuaacaagaucacaaagaaucugaacucuuuauccgaacuggaggucaaaaaucuccaaagacuuagcggcgccauggaugaacugcauaacgagauauuggagcuagacgaaaagguggaugaccugagggcugauaccauuucgucucagaucgagcucgcgguacugcuuuccaaugaagguaucauuaacucagaggacgaacaccuguuggcacucgagcggaaacugaagaaaauguuagggcccagugccguugauaucggcaauggauguuucgagacuaagcacaagugcaaccagacgugccuggaccguauugcugccggcacauuuaaugcaggggaguucagccuaccaaccuuugauucccucaacauaacugccgcuucucugaaugacgauggacuugacaaccauaccaucuugcuguauuacagcacagccgcaucaagucucgcggugacccugaugcuugcuauuuucaucgucuauauggugucccgcgacaaugucagcuguucuaucugccuguga

SEQ ID NO: 150078 - RNA, 1758 nt, Artificial Sequence; identical to SEQ ID NO: 148624
  derived and/or modified sequence opt3 from hemagglutinin__InfluenzaB__AHL93510

SEQ ID NO: 150079 - RNA, 1755 nt, Artificial Sequence
  derived and/or modified sequence opt3 from hemagglutinin__InfluenzaB__AHL93521
augaaggccaucauugcucugcucaugguggucaccagcaacgcagacagaauaugcacaggcaucacuuccucuaauucaccccacguugugaaaacggccacccagggggaaguaaacgugacaggagucauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugccaccauggcuugggccguaccaaaggacaauuauaaaaacgcgacgaauccgcugacuguugaggugcccuacaucuguacagaaggagaggaucagauuaccgucugggguuuccauuccgacaacaagacucagaugaaaaaucuguauggcgauucuaacccucaaagauuuacaagcuccgcaaauggggugaccacgcacuacgugucacagaucggagacuucccagaucagaccgaggacggcggucucccccagagugggaggauagucguugauuauauggugcaaaagccuggaaagacaggcacuauuguauaccagcggggcguguuacugccacagaaagucuggugcgccagcgggcgcucuaaggugaucaaaggaucccuucccuugauuggugaagcugacugucugcaugagaaguacggcgggcuaaacaaaucaaagccguauuacaccggagaacacgccaaagcaaucggcaacugcccuaucuggguuaagacaccccucaagcuggcuaaugguacuaaauaucgaccuccagccaaacuucugaaggagagaggguuuuucggcgcgauugccggauuuuuggagggcgggugggaaggaaugauagcagguuggcacggcuacaccagccauggggcucacggaguggccgucgcugccgaccucaagaguacacaggaggcaaucaacaaaauuaccaagaaucugaacucuuuauccgaacuggaggugaagaaucuccaaaggcuuagcggcgccauggaugaacugcauaacgagaucuuggagcuagacgaaaaaguagaugaccugcgggcugauacuauaucgucucagauugagcucgcgguucugcuuuccaaugaagguaucaucaacucagaggacgaacaccuguuggcacucgagcguaagcugaaaaagauguuagggcccagugccguggauauuggcaauggauguuucgagacgaaacacaagugcaaccagacaugccuggaccgcaucgcugccggcaccuuuaaugcaggggaguucagccuaccaacuuuugauucccucaacauuaccgccgcuucucugaaugacgauggacuugacaaccauacaauauugcuguauuacagcaccgccgcaucaagucucgcggucacucugaugcuugcuaucuucauuguguauauggucuccagagacaaugugagcuguucuaucugccuguga

SEQ ID NO: 150080 - RNA, 1758 nt, Artificial Sequence; identical to SEQ ID NO: 148699
  derived and/or modified sequence opt3 from hemagglutinin__InfluenzaB__AHL93532

SEQ ID NO: 150081 - RNA, 1758 nt, Artificial Sequence; identical to SEQ ID NO: 148661
  derived and/or modified sequence opt3 from hemagglutinin__InfluenzaB__AHL93543

SEQ ID NO: 150082 - RNA, 1758 nt, Artificial Sequence; identical to SEQ ID NO: 148661
  derived and/or modified sequence opt3 from hemagglutinin__InfluenzaB__AHL93554

SEQ ID NO: 150083 - RNA, 1758 nt, Artificial Sequence; identical to SEQ ID NO: 148661
  derived and/or modified sequence opt3 from hemagglutinin__InfluenzaB__AHL93565

SEQ ID NO: 150084 - RNA, 1758 nt, Artificial Sequence; identical to SEQ ID NO: 148699
  derived and/or modified sequence opt3 from hemagglutinin__InfluenzaB__AHL93576

SEQ ID NO: 150085 - RNA, 1758 nt, Artificial Sequence; identical to SEQ ID NO: 148699
  derived and/or modified sequence opt3 from hemagglutinin__InfluenzaB__AHL93587

SEQ ID NO: 150086 - RNA, 1758 nt, Artificial Sequence
  derived and/or modified sequence opt3 from hemagglutinin__InfluenzaB__AHL93609
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacaggugagcacgccaaagcuauagggaacugcccuaucugggugaagacuccccugaaacuagccaauggcaccaaguaucggccuccagcaaaacuccugacagaacgcggauuuuucggcgcuauugccggguuucuugagggagguugggaaggcaugaucgcgggguggcauggauacaccagccacggcgcccacgguguugcaguggcugccgaucugaagaguacucaggaggcuauaaacaagauuacgaaaaauuugaacucucucuccgaacuggaggucaagaauuuacagcgacugagcggggccauggacgagcuccauaacgaaauccuugagcuggaugaaaaaguggacgacuugagagcagauacaaucucgucucaaauugagcuagccguacugcucuccaaugaaggcaucauuaacucagaggacgagcaucugcuugcucuggaaaggaaguugaaaaagaugcucggacccagugcgguugagauaggcaauggguguuucgaaaccaagcacaaaugcaaccagacuugccuggaucggaucgcagccggaaccuuugacgcuggugaguucagcuuaccaacauuugauucccugaauauuaccgccgcaucucuaaacgacgauggccucgacaaucacacuauccugcuuuauuacagcacagccgcuucaaguuuggccgugacgcugaugaucgcaauuuucgucguguauauggucucccgugauaacgugagcuguucuauaugccucuga

SEQ ID NO: 150087 - RNA, 1758 nt, Artificial Sequence; identical to SEQ ID NO: 148699
  derived and/or modified sequence opt3 from hemagglutinin__InfluenzaB__AHL93620

SEQ ID NO: 150088 - RNA, 1758 nt, Artificial Sequence; identical to SEQ ID NO: 150086
  derived and/or modified sequence opt3 from hemagglutinin__InfluenzaB__AHL93631

SEQ ID NO: 150089 - RNA, 1758 nt, Artificial Sequence; identical to SEQ ID NO: 150086
  derived and/or modified sequence opt3 from hemagglutinin__InfluenzaB__AHL93642

SEQ ID NO: 150090 - RNA, 1755 nt, Artificial Sequence
  derived and/or modified sequence opt3 from hemagglutinin__InfluenzaB__AHL93653
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaauuggguucuuugcaaccauggccugggcuguuccaaaggacaauuauaaaaacgccacgaauccgcugacuguggagguccccuacaucuguacagaaggagaggaucagauuaccgugugggguuuccauuccgacaacaagacucagaugaaaaaucuguauggcgauucuaacccucaaaaguuuacaagcuccgcgaauggggugaccacgcacuacgucucacagaucggagacuucccagaucagaccgaggacggcggucucccccagagugggagaauaguuguggauuauaugguacaaaagccuggaaaaacaggcacuauuguguaccagaggggcgucuuacugccacagaagguguggugcgcaagcgggcggucuaaaguuaucaagggaucccuucccuugauuggugaagccgacugucugcaugagaaauacggcgggcuaaacaagucaaaaccguauuacaccggagaacacgcuaaggccaucggcgacugcccuaucugggugaagacaccccucaaacuggcaaacgguacuaaguaucgcccuccagcuaaacuucugaaggagcgaggguuuuucggcgccauugcgggauuuuuggagggcgggugggaaggaaugauagccgguuggcacggcuacaccagccauggggcacacggagucgcuguggccgcugaucucaaaaguacacaggaggccaucaauaagauuaccaagaacuuaaauucucuguccgaacuggagguuaaaaaccuccaaagacuuagcggcgcaauggacgaacugcauaaugagaucuuggagcuagaugaaaagguagacgaucugagggccgacacuauaucgucucagauugagcucgcugugcugcuuuccaacgaagguaucaucaauucagaggaugaacaccuguuggcgcucgagcggaaacugaagaaaauguuagggcccagugcagucgacauuggcaacggauguuucgagacgaagcacaagugcaaucagacaugccuggaucguaucgccgcuggcaccuuuaacgccggggaguucagccuaccaacuuuugacucccucaauauuaccgcagccucucugaacgaugacggacuugacaaucauacaauauugcuguauuacagcaccgcugccucaagucucgcagugacucugaugcuugcgaucuucauugucuauauggugucccgcgauaacguuagcuguucuaucugccuguga

SEQ ID NO: 150091 - RNA, 1758 nt, Artificial Sequence; identical to SEQ ID NO: 148699
  derived and/or modified sequence opt3 from hemagglutinin__InfluenzaB__AHL93664

SEQ ID NO: 150092 - RNA, 1758 nt, Artificial Sequence; identical to SEQ ID NO: 148624
  derived and/or modified sequence opt3 from hemagglutinin__InfluenzaB__AHL93675

SEQ ID NO: 150093 - RNA, 1758 nt, Artificial Sequence; identical to SEQ ID NO: 150086
  derived and/or modified sequence opt3 from hemagglutinin__InfluenzaB__AHL93686

SEQ ID NO: 150094 - RNA, 1758 nt, Artificial Sequence; identical to SEQ ID NO: 150086
  derived and/or modified sequence opt3 from hemagglutinin__InfluenzaB__AHL93697

SEQ ID NO: 150095 - RNA, 1758 nt, Artificial Sequence
  derived and/or modified sequence opt3 from hemagglutinin__InfluenzaB__AHL93708
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacuauuaccuaccaaagaggaauccugcucccacagaagguguggugcgcgagcgguaggucuaaagucaucaagggcuccuuaccccugauuggggaagcagacugucuucaugagaaauauggaggcuugaauaagucaaagccguacuacacagguaaacacgccaaggcuauagggaacugcccuaucugggugaaaacuccccugaagcuagccaauggcaccaaauaucggccuccagcaaagcuccugacagagcgcggauuuuucggcgcuauugccggguuucuugaaggagguugggagggcaugaucgcgggguggcauggauacaccagccacggcgcccacgguguugcaguggcugccgaucugaagaguacucaggaagcuauaaacaaaauuacgaagaauuugaacucucucuccgagcuggaagucaaaaauuuacagcgacugagcggggccauggacgagcuccauaacgagauccuugaacuggaugagaagguggacgacuugagagcagauacaaucucgucucaaauugaacuagccguacugcucuccaaugagggcaucauuaacucagaagacgagcaucugcuugcucuggagaggaaauugaagaagaugcucggacccagugcgguugaaauaggcaauggguguuucgagaccaaacacaagugcaaccagacuugccuggaucggaucgcagccggaaccuuugacgcuggugaguucagcuuaccaacauuugauucccugaauauuaccgccgcaucucuaaacgacgauggccucgacaaucacacuauccugcuuuauuacagcacagccgcuucaaguuuggccgugacgcugaugaucgcaauuuucgucguguauauggucucccgugauaacgugagcuguucuauaugccucuga

SEQ ID NO: 150096 - RNA, 1758 nt, Artificial Sequence
  derived and/or modified sequence opt3 from hemagglutinin__InfluenzaB__AHL93719
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugauaccagucacuucuggcuguuuucccaucaugcaugaucgaaccaaaauucgucaacugccuaaucuucugagagguuacgaacacaucagguugucgacacauaacgugauuaaugccgagaacgcaccagggggacccuauaagaucggcacuucaggcagcugcccuaauauaaccaacgggaauggauucuuugccacaauggcuugggcaguaccgaaaaacgacaagaauaaaaccgccacgaacccacucacuauugaaguucccuacaucuguacagagggugaggaucagauuaccguguggggcuuccacagugacaaugaaacucagauggcuaagcuguauggggauuccaagccucagaaauuuacaucuagcgccaacggagucaccacgcacuacgugucccaaaucggcgguuucccaaaccagaccgaggacgggggacugccccagucaggccggaucguggucgauuauaugguucagaagaguggcaaaacagggacuauuaccuaccaacgcggaauacucuuaccucagaagguguggugcgcgagcgguagaucuaaaguaaucaagggcucccugccacuuauuggggaagcagacuguuugcaugagaaauauggaggccugaauaagucaaagcccuacuacacaggugagcacgccaaagcuaucgggaacugcccgauaugggugaagacuccucuaaaacucgccaauggcaccaaguauaggcccccagcaaaacugcuuaaggaacggggauuuuucggcgcuauugccggguuucuggagggagguugggaaggcaugaucgcgggguggcauggauacacaagccacggcgcccacggugucgcaguggcugccgauuugaagaguacccaggaggcuaucaacaaaauuacuaagaaucucaacucucuguccgaauuagagguuaaaaaucugcagcgccucagcggggccauggacgagcuucauaacgaaauccuggaguuggaugaaaagguggacgaccuacgagcagauacgauuucgucucaaauagagcuggccguccuccuguccaaugaaggcaucauuaacucagaggacgagcaccuucuggcuuuggaaagaaaacucaagaagaugcugggaccuagugcgguggagaucggcaauggguguuucgaaacaaaacauaagugcaaccagaccugcuuagauaggaucgcagccggaacuuuugacgcuggugaguucagccugcccaccuuugauucccuaaauauuacagccgcaucucucaacgacgauggccuggacaaucacaccauacuuuuguauuacagcacugccgcuucaagucuggccguaacacucaugaucgcaauuuucguuguguauauggucucccgggauaacgugagcuguucuaucugccuguga

SEQ ID NO: 150097 - RNA, 1758 nt, Artificial Sequence; identical to SEQ ID NO: 148699
  derived and/or modified sequence opt3 from hemagglutinin__InfluenzaB__AHL93730

SEQ ID NO: 150098 - RNA, 1758 nt, Artificial Sequence; identical to SEQ ID NO: 148699
  derived and/or modified sequence opt3 from hemagglutinin__InfluenzaB__AHL93741

SEQ ID NO: 150099 - RNA, 1758 nt, Artificial Sequence; identical to SEQ ID NO: 148661
  derived and/or modified sequence opt3 from hemagglutinin__InfluenzaB__AHL93752

SEQ ID NO: 150100 - RNA, 1758 nt, Artificial Sequence; identical to SEQ ID NO: 150086
  derived and/or modified sequence opt3 from hemagglutinin__InfluenzaB__AHL93763

SEQ ID NO: 150101 - RNA, 1758 nt, Artificial Sequence; identical to SEQ ID NO: 148624
  derived and/or modified sequence opt3 from hemagglutinin__InfluenzaB__AHL93774

SEQ ID NO: 150102 - RNA, 1758 nt, Artificial Sequence; identical to SEQ ID NO: 150086
  derived and/or modified sequence opt3 from hemagglutinin__InfluenzaB__AHL93785

SEQ ID NO: 150103 - RNA, 1758 nt, Artificial Sequence; identical to SEQ ID NO: 148699
  derived and/or modified sequence opt3 from hemagglutinin__InfluenzaB__AHL93796

SEQ ID NO: 150104 - RNA, 1758 nt, Artificial Sequence; identical to SEQ ID NO: 148624
  derived and/or modified sequence opt3 from hemagglutinin__InfluenzaB__AHL93818

SEQ ID NO: 150105 - RNA, 1758 nt, Artificial Sequence
  derived and/or modified sequence opt3 from hemagglutinin__InfluenzaB__AHL93829
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaauacugagaacgccccagggggacccuauaagauuggcaccucaggcagcugcccuaauaucacaaacgggaauggauucuuugcaaccauggccugggcuguaccgaaaaacgacaagaauaaaacggcaacuaacccacucacaauagaaguucccuacauuuguaccgagggugaggaucagaucacuguguggggcuuccacagugacaaugaaacacagauggccaagcuguauggggauuccaagccucagaaauuuaccucuagcgcuaacggagucacgacccacuacgugucccaaauuggcgguuucccaaaccagacagaggacgggggacugccccagucaggccgcaucguggucgauuauaugguucagaagaguggcaaaacugggaccaucacauaccaaagagguauucucuuaccucagaagguguggugcgccagcggaaggucuaaaguaauaaagggcucccugccacuuaucggggaagcggacuguuugcaugagaaauauggaggccugaauaagucaaagcccuacuacacuggugagcacgcaaaagccauugggaacugcccgaucugggugaagaccccucuaaaacucgcuaauggcacaaaguaucggcccccagccaaacugcuuaaggaacgcggauuuuucggcgcaauagcuggguuucuggagggagguugggaaggcaugauugccggguggcauggauacaccagccacggcgcgcacggugucgccguggcagcugauuugaagaguacucaggaggccaucaacaaaaucacgaagaaucucaacucucuguccgaauuagagguuaaaaaucugcagcgacucagcggggcuauggacgagcuucauaacgaaauucuggaguuggaugaaaagguggacgaccuaagagccgauacaaucucgucucaaauugagcuggcaguccuccuguccaaugaaggcauaaucaacucagaggacgagcaccuucuggccuuggaaaggaaacucaagaagaugcugggaccuagugcuguggagauuggcaauggguguuucgaaaccaaacauaagugcaaccagacuugcuuagaucggaucgcggcaggaaccuuugacgccggugaguucagccugcccacauuugauucccuaaauaucaccgcugccucucucaacgacgauggccuggacaaucacacuauucuuuuguauuacagcacagcagccucaagucuggcuguaacgcucaugauagccaucuucguuguguauauggucucccgugauaacgugagcuguucuauuugccuguga

SEQ ID NO: 150106 - RNA, 1758 nt, Artificial Sequence; identical to SEQ ID NO: 149005
  derived and/or modified sequence opt3 from hemagglutinin__InfluenzaB__AHL93840

SEQ ID NO: 150107 - RNA, 1758 nt, Artificial Sequence; identical to SEQ ID NO: 148699
  derived and/or modified sequence opt3 from hemagglutinin__InfluenzaB__AHL93851

SEQ ID NO: 150108 - RNA, 1758 nt, Artificial Sequence; identical to SEQ ID NO: 148699
  derived and/or modified sequence opt3 from hemagglutinin__InfluenzaB__AHL93862

SEQ ID NO: 150109 - RNA, 1758 nt, Artificial Sequence
  derived and/or modified sequence opt3 from hemagglutinin__InfluenzaB__AHL93873
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccacaccaaccaagagucauuucgccaaucugaaagguacugaaacaaggggcgaguuguguccgaagugcuuaaacuguaccgaucuggacguggcgcuagggcggcccaaaugcacgggaaagauuccuagcgcucgcguuuccauccuccacgaagugcgaccagucacuucuggcuguuuucccauaaugcaugaucguaccaagaucagacaacugccuaaucuucugagggguuacgagcacauucgguugucgacacauaacgugaucaaugccgaaaacgcaccagggggacccuauaaaauuggcacuucaggcagcugcccuaauaucaccaacgggaauggauucuuugccacaauggcuugggcaguaccaaagaacgacaaaaauaagaccgccacgaacccgcucacuauagagguucccuacauuuguacagagggugaagaucagaucaccguguggggcuuccacagugacaaugagacucagauggcuaaacuguauggggauuccaagccucagaaguuuacaucuagcgccaacggagucaccacgcacuacgugucccaaauuggcgguuucccaaaccagaccgaagacgggggacugccccagucaggccgcaucguggucgauuauaugguucagaaaaguggcaagacagggacuaucaccuaccaaagagguauucucuuaccucagaaaguguggugcgcgagcggaaggucuaagguaauaaaaggcucccugccacuuaucggggaggcagacuguuugcaugagaaguauggaggccugaauaaaucaaagcccuacuacacaggugaacacgccaaggcuauugggaacugcccgaucugggugaaaacuccucuaaagcucgccaauggcaccaaauaucggcccccagcaaagcugcuuaaagagcgcggauuuuucggcgcuauagccggguuucuggaaggagguugggagggcaugauugcgggguggcauggauacacaagccacggcgcccacggugucgcaguggcugccgauuugaagaguacccaggaagcuaucaacaagaucacuaaaaaucucaacucucuguccgaguuagagguuaagaaucugcagcgacucagcggggccauggacgaacuucauaacgagauucuggaauuggaugagaaaguggacgaccuaagagcagauacgaucucgucucaaauugaacuggccguccuccuguccaaugagggcauaaucaacucagaggacgaacaccuucuggcuuuggagaggaagcucaaaaagaugcugggaccuagugcgguggaaauuggcaauggguguuucgagacaaagcauaaaugcaaccagaccugcuuagaucggaucgcagccggaacuuuugacgcuggugaguucagccugcccaccuuugauucccuaaauaucacagccgcaucucucaacgacgauggccuggacaaucacaccauucuuuuguauuacagcacugccgcuucaagucuggccguaacacucaugauagcaaucuucguuguguauauggucucccgugauaacgugagcuguucuauuugccuguga

SEQ ID NO: 150110 - RNA, 1758 nt, Artificial Sequence; identical to SEQ ID NO: 148699
  derived and/or modified sequence opt3 from hemagglutinin__InfluenzaB__AHL93884

SEQ ID NO: 150111 - RNA, 1758 nt, Artificial Sequence; identical to SEQ ID NO: 148699
  derived and/or modified sequence opt3 from hemagglutinin__InfluenzaB__AHL93895

SEQ ID NO: 150112 - RNA, 1758 nt, Artificial Sequence; identical to SEQ ID NO: 148699
  derived and/or modified sequence opt3 from hemagglutinin__InfluenzaB__AHL93906

SEQ ID NO: 150113 - RNA, 1758 nt, Artificial Sequence; identical to SEQ ID NO: 148699
  derived and/or modified sequence opt3 from hemagglutinin__InfluenzaB__AHL93917

SEQ ID NO: 150114 - RNA, 1758 nt, Artificial Sequence; identical to SEQ ID NO: 148624
  derived and/or modified sequence opt3 from hemagglutinin__InfluenzaB__AHL93928

SEQ ID NO: 150115 - RNA, 1758 nt, Artificial Sequence; identical to SEQ ID NO: 148661
  derived and/or modified sequence opt3 from hemagglutinin__InfluenzaB__AHL93939

SEQ ID NO: 150116 - RNA, 1758 nt, Artificial Sequence; identical to SEQ ID NO: 148699
  derived and/or modified sequence opt3 from hemagglutinin__InfluenzaB__AHL93950

SEQ ID NO: 150117 - RNA, 1758 nt, Artificial Sequence; identical to SEQ ID NO: 148661
  derived and/or modified sequence opt3 from hemagglutinin__InfluenzaB__AHL93961

SEQ ID NO: 150118 - RNA, 1758 nt, Artificial Sequence
  derived and/or modified sequence opt3 from hemagglutinin__InfluenzaB__AHL93972
augaaggccaucauugugcugcucauggucguuaccagcacagcugacagaauaugcacuggcaucacguccucuaacucaccccacgugguaaaaaccgcaacacagggggaggugaaugucacuggagugauuccucuuaccacaaccccaacuaagagucauuucgccaaccugaaagguacagaaaccaggggcaaguuguguccgaaaugcuuaaauuguacggaucuggacguugcgcuagggcggcccaagugcacuggaaagaucccuagcgcucgcguguccauucuccacgagguccgaccagugaccucuggcuguuuucccaucaugcaugaucguacaaaaauaagacaacugccuaaccuucugagggguuacgaacacauccgguugucgacucauaauguaauuaacgccgagaaugcaccagggggacccuauaagaucggcaccucaggcagcugcccuaacguuacaaaugggaacggauucuuugccaccauggcuugggcagugccgaaaaaugacaagaacaaaacggccacuaauccacucacaauugaaguccccuacaucuguaccgagggugaggaucagauaacuguguggggcuuccacagugacaacgaaacacagauggcuaagcuguauggggauuccaagccucagaaauuuaccucuagcgccaauggagugacgacccacuacgucucccaaauuggcgguuucccaaaccagacagaggacgggggacugccccagucaggccgcaucguuguggauuauaugguacagaagaguggcaaaacugggaccauuacauaccaaagaggaauccucuuaccucagaagguguggugcgcgagcgguaggucuaaagucaucaagggcucccugccacuuauuggggaagcagacuguuugcaugagaaauauggaggccugaacaagucaaagcccuacuacacuggugagcacgccaaagcuguggggaauugcccgauauggguuaagaccccucuaaaacucgccaacggcacaaaguaucggcccccagcaaaacugcuuaaggaacgcggauuuuucggcgcuaucgccggguuucuggagggagguugggaaggcaugauugcgggguggcauggauacaccagccacggcgcccacgguguggcagucgcugccgauuugaagaguacucaggaggcuaucaauaaaauaacgaagaaccucaauucucuguccgaauuagaggugaaaaaccugcagcgacucagcggggccauggacgagcuucauaaugaaauucuggaguuggaugaaaagguagacgaccuaagagcagauacaaucucgucucaaaucgagcuggccguucuccuguccaacgaaggcauuaucaauucagaggacgagcaccuucuggcuuuggaaaggaaacucaagaagaugcugggaccuagugcgguggagauuggcaacggguguuucgaaaccaaacauaagugcaaucagacuugcuuagaucggauagcagccggaaccuuugacgcuggugaguucagccugcccacauuugauucccuaaacaucaccgccgcaucucucaaugacgauggccuggacaaccacacuauucuuuuguauuacagcacagccgcuucaagucuggccgucacgcucaugaucgcaaucuucguggucuauauggugucccgugauaauguuagcuguucuauuugccuguga

SEQ ID NO: 150119 - RNA, 1758 nt, Artificial Sequence; identical to SEQ ID NO: 148624
  derived and/or modified sequence opt3 from hemagglutinin__InfluenzaB__AHL93983

SEQ ID NO: 150120 - RNA, 1755 nt, Artificial Sequence
  derived and/or modified sequence opt3 from hemagglutinin__InfluenzaB__AHL93994
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaagaaaaguuacuucgccaaucugaaggguaccaaaacuaggggcaaguuguguccggauugcuuaaacuguacagaccuggauguugcgcuagggcggcccaugugcgugggaaccacgccuagcgcuaaggccuccauccuccaugaaguccgcccagugacuucuggcuguuuucccauuaugcacgaccgaaccaaaauccgucaacuggcaaaucuucugagagguuaugagaacauaagguugucgacacagaauguaaucgaugccgaaaaggcuccugggggaccauaccggcucggcacuucaggcagcugccccaacgcaaccaguaaauccggguucuuugccacaauggcuugggccguuccuaaggacaauaacaaaaaugcgaccaacccacugacgguggaggucccguauauuugugcagaaggagaggaucagaucacugugugggguuuccauucugacaauaagacacagaugaagaaccuguacggcgauagcaauccccaaaaauuuaccuccucagccaacggggugacuacacacuaugucagucagauuggaggcuucccugaccagaccgaggauggugggcucccacagagcggacgcaucguuguggacuacaugaugcaaaagcccggcaaaacgggcaccauaguauaucagagagggguguuacugccucagaaggucuggugcgcuucuggaagguccaaagugauuaaggguucacuuccauugaucggcgaagccgauugucugcaugagaaauacgggggacuaaacaagagcaagcccuacuauacaggcgaacacgcaaaagcuauugguaauugcccgaucuggguuaagacuccucucaaacuggccaacgggaccaaguaccggcccccagcgaaacuucugaaggagcgcggcuuuuucggagccaucgcaggcuuuuuggaagggggaugggaagguaugauugcuggcuggcacggguauacaagucauggagcccacggcguggcugucgccgcagaccucaagucuacucaggaggccauaaauaaaaucaccaagaacuuaaauucccugagcgaacuggaggugaaaaaccuccaacgacuuucgggugcuauggacgaacugcauaaugagauuuuggagcuagaugaaaagguagacgaucugagagcggacacaaucucuucccagauagagcucgcaguucugcuuucaaacgaagggauuaucaauagugaggaugaacaccuguuggcccucgagaggaaacugaagaagauguuaggcccuagcgcuguggacaucggaaacggcuguuucgagaccaaacacaagugcaaucagacuugccuggaucggauugccgcagggacguuuaacgccggagaguucucccuacccacauuugacucucucaauaucaccgcugccagccugaacgaugacggucuugauaaucauacuauuuugcuguacuauucaaccgcagcgaguucccucgcugucacacugaugcuugccauauucaucguguacaugauuagccgugacaacgucucuuguucaaucugccuguga

SEQ ID NO: 150121 - RNA, 1758 nt, Artificial Sequence; identical to SEQ ID NO: 148699
  derived and/or modified sequence opt3 from hemagglutinin__InfluenzaB__AHL94005

SEQ ID NO: 150122 - RNA, 1758 nt, Artificial Sequence; identical to SEQ ID NO: 148699
  derived and/or modified sequence opt3 from hemagglutinin__InfluenzaB__AHL94016

SEQ ID NO: 150123 - RNA, 1758 nt, Artificial Sequence
  derived and/or modified sequence opt3 from hemagglutinin__InfluenzaB__AHL94027
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugguucagaagaguggcaaaacagggacuaucaccuaccaaaugggagugcucuuaccucagaagguauggugcgcgagcgguagaucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguauaggcccccagcaaaacugcuuaaggaacggggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgccucagcggggccauggacgagcuucauaacgaaauccuggaguuggaugaaaaggucgacgaccuacgagcagauacgauuucgucucaaaucgagcuggccgugcuccuguccaaugaaggcauuauaaacucagaggacgagcaccuucuggcuuuggaaagaaaacucaagaagaugcugggaccuagugcgguagagaucggcaauggguguuucgaaacaaaacauaagugcaaccagaccugcuuagauaggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgggauaacgucagcuguucuaucugccuguga

SEQ ID NO: 150124 - RNA, 1758 nt, Artificial Sequence; identical to SEQ ID NO: 148661
  derived and/or modified sequence opt3 from hemagglutinin__InfluenzaB__AHL94038

SEQ ID NO: 150125 - RNA, 1758 nt, Artificial Sequence; identical to SEQ ID NO: 148624
  derived and/or modified sequence opt3 from hemagglutinin__InfluenzaB__AHL94049

SEQ ID NO: 150126 - RNA, 1758 nt, Artificial Sequence; identical to SEQ ID NO: 148699
  derived and/or modified sequence opt3 from hemagglutinin__InfluenzaB__AHL94060

SEQ ID NO: 150127 - RNA, 1758 nt, Artificial Sequence
  derived and/or modified sequence opt3 from hemagglutinin__InfluenzaB__AHL94071
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccacgcacuacgugucccaaauuggcgguuucccaaaccagaccgaggacgggggacugccccagucaggccgcaucguggucgauuauaugaugcagaagaguggcaaaacagggacuaucaccuaccaaagagguauucucuuaccucagaagguuuggugcgcgagcggaaggucuaaagugauaaagggcucccugccacuuaucggggaagcagacuguuugcaugagaaauauggaggccugaauaagucaaagcccuacuacacaggugagcacgccaaagcuauugggaacugcccgaucuggguaaagacuccucuaaaacucgccaauggcaccaaguaucggcccccagcaaaacugcuuaaggaacgcggauuuuucggcgcuauagccggguuucuggagggagguugggaaggcaugauugcgggguggcauggauacacaagccacggcgcccacgguguggcagucgcugccgauuugaagaguacccaggaggcuaucucuaaaaucacuaagaaccucaauucccugagcgaauuagaggugaaaaaccugcagcgacucucgggggccauggacgagcuucauaaugaaauucuggaguuggaugaaaagguugacgaccuaagagcagauacgaucucuucccaaauugagcuggccgugcuccugucaaacgaaggcauaaucaauagugaggacgagcaccuucuggcuuuggaaaggaaacucaagaagaugcugggaccuagcgcggucgagauuggcaacggguguuucgaaacaaaacauaagugcaaucagaccugcuuagaucggaucgcagccggaacuuuugacgcuggugaguucucccugcccaccuuugauucucuaaacaucacagccgcaagccucaaugacgauggccuggacaaccacaccauucuuuuguauuacucaacugccgcuaguucccuggccgugacacucaugauagcaaucuucguaguuuauauggugagccgugauaaugucucuuguucaauuugccuguga

SEQ ID NO: 150128 - RNA, 1755 nt, Artificial Sequence
  derived and/or modified sequence opt3 from hemagglutinin__InfluenzaB__AHL94082
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaauucgaccagucaccucuggcuguuuucccaucaugcacgaccguacaaagauaagacaacugccuaaucuucugagggguuaugagaacauccgguugucgacucagaaugugauugaugcagaaaaggccccagggggacccuaccgccucggcaccucaggcagcugcccuaacgcuacaaguaaaaucggguucuuugcaaccauggccugggcuguaccaaaggacaauuauaaaaacgccacgaauccgcugacuguugaggugcccuacauuuguacagaaggagaggaucagaucaccgucugggguuuccauuccgacaacaagacucagaugaaaaaucuguauggcgauucuaacccucaaaaguuuacaagcuccgcgaauggggugaccacgcacuacgugucacagauaggagacuucccagaucagaccgaggacggcggucucccccagagugggagaauugucguugauuauaugaugcaaaagccuggaaaaacaggcacuaucguguaccagaggggcguauuacugccacagaagguguggugcgcaagcgggcggucuaaagucauuaagggaucccuucccuugaucggugaagccgacugucugcaugagaaauacggcgggcuaaacaagucaaaaccguauuacaccggagaacacgcuaaggccaucggcaacugcccuauuugggugaagacaccccucaaacuggcaaaugguacuaaguaucgcccuccagcuaaacuucugaaggagcgaggguuuuucggcgccauagcgggauuuuuggagggcgggugggaaggaaugaucgccgguuggcacggcuacaccagccauggggcacacggaguugcuguggccgcugaccucaaaaguacacaggaggccauuaacaagaucaccaagaaucugaacucuuuauccgaacuggaggucaaaaaucuccaaagacuuagcggcgcaauggaugaacugcauaacgagauauuggagcuagacgaaaagguggaugaccugagggccgauacuauuucgucucagaucgagcucgcuguacugcuuuccaaugaagguaucauuaacucagaggacgaacaccuguuggcgcucgagcggaaacugaagaaaauguuagggcccagugcaguugauaucggcaauggauguuucgagacgaagcacaagugcaaccagacaugccuggaccguauugccgcuggcaccuuuaaugccggggaguucagccuaccaacuuuugauucccucaacauaaccgcagccucucugaaugacgauggacuugacaaccauacaaucuugcuguauuacagcaccgcugccucaagucucgcagugacucugaugcuugcgauuuucaucgucuauauggugucccgcgacaaugucagcuguucuaucugccuguga

SEQ ID NO: 150129 - RNA, 1758 nt, Artificial Sequence; identical to SEQ ID NO: 148661
  derived and/or modified sequence opt3 from hemagglutinin__InfluenzaB__AHL94093

SEQ ID NO: 150130 - RNA, 1758 nt, Artificial Sequence; identical to SEQ ID NO: 148699
  derived and/or modified sequence opt3 from hemagglutinin__InfluenzaB__AHL94102

SEQ ID NO: 150131 - RNA, 1758 nt, Artificial Sequence
  derived and/or modified sequence opt3 from hemagglutinin__InfluenzaB__AHL94113
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugccucaauaucaccaacgggaauggauucuuugccacaauggcuugggcaguaccuaaaaacgacaagaauaaaaccgccacgaacccacugacuauagaaguuccguacauuuguacagagggugaggaucagaucaccguguggggcuuccacagugacaaugaaacucagauggcuaagcuguauggggauuccaagccccagaaauuuacaucuagcgccaacggagucaccacgcacuacgugucccaaauuggcgguuucccuaaccagaccgaggacgggggacucccacagucaggccgcaucguggucgauuauaugguucagaagaguggcaaaacagggacuaucaccuaccaaagaggaauuuuacugccccagaagguguggugcgcgagcgguaggucuaaaguaauaaagggcucccuuccuuugaucggggaagcagacugucugcaugagaaauauggaggccuaaauaagucaaagccauacuacacaggugagcacgccaaagcuauugggaacugccccaucugggugaagacuccgcucaaacuggccaauggcaccaaguaucggccucccgcaaaacuucugaaggaacgcggauuuuucggcgcuauagccggguuuuuggagggagguugggaaggcaugauugcgggguggcauggauacacaagccacggcgcccacggugucgcaguggcugccgaucucaagaguacccaggaggcuaucaacaaaaucacuaagaaucugaacucuuuauccgaacuggagguuaaaaaucuccagcgacuuagcggggccauggacgagcugcauaacgaaauuuuggagcuagaugaaaagguggacgaccugagagcagauacgaucucgucucaaauugagcucgccguccugcuuuccaaugaaggcauaaucaacucagaggacgagcaccuguuggcucucgaaaggaaacugaagaagauguuaggaccaagugcgguggagauuggcaauggguguuucgaaacaaaacauaagugcaaccagaccugccuggaucggaucgcagccggaacuuuugacgcuggugaguucagccuaccuaccuuugauucccucaauaucacagccgcaucucugaacgacgauggccuugacaaucacaccauuuugcuguauuacagcacugccgcuucaagucucgccguaacacugaugauagcaaucuucguuguguauauggucucccgugauaacgugagcuguucuauuugccuuuga

SEQ ID NO: 150132 - RNA, 1758 nt, Artificial Sequence
  derived and/or modified sequence opt3 from hemagglutinin__InfluenzaB__AHL94124
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgagauacgaccagugacuucuggcuguuuucccaucaugcaugaucguaccaaaauuagacaacugccuaaucuucugagggguuacgaacacauccgguugucgacacauaacgucauuaaugccgagaacgcaccagggggacccuauaagaucggcacuucaggcagcugcccuaauauaaccaacgggaauggauucuuugccacaauggcuugggcagugccgaaaaacgacaagaauaaaaccgccacgaacccacucacuauugaaguacccuacaucuguacagagggugaggaucagauuaccguuuggggcuuccacagugacaaugaaacucagauggcuaagcuguauggggauuccaagccucagaaauuuacaucuagcgccaacggagugaccacgcacuacgucucccaaaucggcgguuucccaaaccagaccgaggacgggggacugccccagucaggccgcaucgugguggauuauaugguccagaagaguggcaaaacagggacuauuaccuaccaaagaggaauacucuuaccucagaagguuuggugcgcgagcgguaggucuaaagugaucaagggcucccugccacuuauuggggaagcagacuguuugcaugagaaauauggaggccugaauaagucaaagcccuacuacacaggugagcacgccaaagcuaucgggaacugcccgauauggguaaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguggcagucgcugccgauuugaagaguacccaggaggcuaucaacaaaauuacuaagaaucucaacucucuguccgaauuagaggugaaaaaucugcagcgacucagcggggccauggacgagcuucauaacgaaauccuggaguuggaugaaaagguugacgaccuaagagcagauacgauuucgucucaaauagagcuggccgugcuccuguccaaugaaggcaucauuaacucagaggacgagcaccuucuggcuuuggaaaggaaacucaagaagaugcugggaccuagugcggucgagaucggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauacuuuuguauuacagcacugccgcuucaagucuggccgugacacucaugaucgcaauuuucguaguuuauauggugucccgugauaacgucagcuguucuaucugccuguga

SEQ ID NO: 150133 - RNA, 1758 nt, Artificial Sequence; identical to SEQ ID NO: 148624
  derived and/or modified sequence opt3 from hemagglutinin__InfluenzaB__AHL94135

SEQ ID NO: 150134 - RNA, 1758 nt, Artificial Sequence; identical to SEQ ID NO: 148624
  derived and/or modified sequence opt3 from hemagglutinin__InfluenzaB__AHL94146

SEQ ID NO: 150135 - RNA, 1758 nt, Artificial Sequence; identical to SEQ ID NO: 148699
  derived and/or modified sequence opt3 from hemagglutinin__InfluenzaB__AHL94157

SEQ ID NO: 150136 - RNA, 1758 nt, Artificial Sequence; identical to SEQ ID NO: 148699
  derived and/or modified sequence opt3 from hemagglutinin__InfluenzaB__AHL94168

SEQ ID NO: 150137 - RNA, 1758 nt, Artificial Sequence; identical to SEQ ID NO: 148624
  derived and/or modified sequence opt3 from hemagglutinin__InfluenzaB__AHL94179

SEQ ID NO: 150138 - RNA, 1758 nt, Artificial Sequence; identical to SEQ ID NO: 148624
  derived and/or modified sequence opt3 from hemagglutinin__InfluenzaB__AHL94190

SEQ ID NO: 150139 - RNA, 1758 nt, Artificial Sequence
  derived and/or modified sequence opt3 from hemagglutinin__InfluenzaB__AHL94201
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugaaacaauggccugggcuguaccgaaaaacgacaagaauaaaaccgcaacgaacccacucacuauagagguucccuacauuuguacagagggugaagaucagaucaccguguggggcuuccacagugacaaugagacucagauggccaagcuguauggggauuccaagccucagaaauuuacaucuagcgcuaacggagucaccacgcacuacgugucccaaauuggcgguuucccaaaccagaccgaagacgggggacugccccagucaggccgcaucguggucgauuauaugguucagaagaguggcaaaacagggacuaucaccuaccaaagagguauucucuuaccucagaagguguggugcgccagcggaaggucuaaaguaauaaagggcucccugccacuuaucggggaggcggacuguuugcaugagaaauauggaggccugaauaagucaaagcccuacuacacaggugaacacgcaaaagccauugggaacugcccgaucugggugaagacuccucuaaaacucgcuaauggcaccaaguaucggcccccagccaaacugcuuaaggagcgcggauuuuucggcgcaauagcuggguuucuggaaggagguugggagggcaugauugccggguggcauggauacacaagccacggcgcgcacggugucgccguggcagcugauuugaagaguacccaggaagccaucaacaaaaucacuaagaaucucaacucucuguccgaguuagagguuaaaaaucugcagcgacucagcggggcuauggacgaacuucauaacgagauucuggaauuggaugagaagguggacgaccuaagagccgauacgaucucgucucaaauugaacuggcaguccuccuguccaaugagggcauaaucaacucagaggacgaacaccuucuggccuuggagaggaaacucaagaagaugcugggaccuagugcuguggaaauuggcaauggguguuucgagacaaaacauaagugcaaccagaccugcuuagaucggaucgcggcaggaacuuuugacgccggugaguucagccugcccaccuuugauucccuaaauaucacagcugccucucucaacgacgauggccuggacaaucacaccauucuuuuguauuacagcacugcagccucaagucuggcuguaacacucaugauagccaucuucguuguguauauggucucccguaacaacgugagcuguucuauuugccuguga

SEQ ID NO: 150140 - RNA, 1758 nt, Artificial Sequence
  derived and/or modified sequence opt3 from hemagglutinin__InfluenzaB__AHL94212
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucaggugaccguguggggcuuccacagugacaaugaaacucagauggcuaagcuguauggggauuccaagccucagaaauuuacaucuagcgccaacggagucaccacgcacuacguuucccaaauaggcgguuucccaaaccagaccgaggacgggggacugccccagucaggccgcauugugguagauuauauggugcagaagaguggcaaaacagggacuaucaccuaccaaagagguauucucuuaccucagaaggucuggugcgcgagcggaaggucuaaagugaucaagggcucccugccacuuaucggggaagcagacuguuugcaugagaaauauggaggccugaauaagucaaagcccuacuacacaggugagcacgccaaagcuauugggaacugcccgauauggguuaagacuccucuaaaacucgccaauggcaccaaguaucggcccccagcaaaacugcuuaaggaacgcggauuuuucggcgcuaucgccggguuucuggagggagguugggaaggcaugauugcgggguggcauggauacacaagccacggcgcccacgguguggcagucgcugccgauuugaagaguacccaggaggcuaucaacaaaauaacuaagaaucucaacucucuguccgaauuagaggugaaaaaucugcagcgacucagcggggccauggacgagcuucauaacgaaauucuggaguuggaugaaaagguagacgaccuaagagcagauacgaucucgucucaaaucgagcuggccguucuccuguccaaugaaggcauuaucaacucagaggacgagcaccuucuggcuuuggaaaggaaacucaagaagaugcugggaccuagugcgguggagauuggcaauggguguuucgaaacaaaacauaagugcaaccagaccugcuuagaucggauagcagccggaacuuuugacgcuggugaguucagccugcccaccuuugauucccuaaauaucacagccgcaucucucaacgacgauggccuggacaaucacaccauucuuuuguauuacagcacugccgcuucaagucuggccgucacacucaugaucgcaaucuucguggucuauauggugucccgugauaacguuagcuguucuauuugccuguga

SEQ ID NO: 150141 - RNA, 1758 nt, Artificial Sequence; identical to SEQ ID NO: 148699
  derived and/or modified sequence opt3 from hemagglutinin__InfluenzaB__AHL94220

SEQ ID NO: 150142 - RNA, 1758 nt, Artificial Sequence; identical to SEQ ID NO: 148699
  derived and/or modified sequence opt3 from hemagglutinin__InfluenzaB__AHL94231

SEQ ID NO: 150143 - RNA, 1758 nt, Artificial Sequence
  derived and/or modified sequence opt3 from hemagglutinin__InfluenzaB__AHL94242
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccaaagaacgacaagaauaaaaccgccacgaacccgcucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgaaugguaggagcaaagucaucaagggcucucugccacuuauuggggaagcagacuguuugcaugagaaauauggaggccugaacaaguccaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaucacacggcgcccacgguguugcaguggcugccgauuugaaaagcacccaggaggcuauaaauaaaauuacuaagaaccucaauagucugucugaauuagaggucaaaaaccugcagcgacucuccggggccauggacgagcuucauaaugaaauccuggaguuggaugaaaagguggacgaccuaagagcagauacgaucagcucgcaaauugagcuggccguacuccugucuaacgaaggcaucauuaauuccgaggacgagcaccuucuggcuuuggaaaggaaacucaagaagaugcugggaccuucagcgguugagauaggcaacggguguuucgaaacaaaacauaagugcaaucagaccugcuuagaucggaucgcagccggaacuuuugacgcuggugaguucagucugcccaccuuugauagccuaaacauuacagccgcaucccucaaugacgauggccuggacaaccacaccauccuuuuguauuacucuacugccgcuagcucacuggccgugacacucaugaucgcaauuuucgucguguauauggucagucgugauaacguguccuguagcauaugccuguga

SEQ ID NO: 150144 - RNA, 1758 nt, Artificial Sequence; identical to SEQ ID NO: 148661
  derived and/or modified sequence opt3 from hemagglutinin__InfluenzaB__AHL94253

SEQ ID NO: 150145 - RNA, 1755 nt, Artificial Sequence
  derived and/or modified sequence opt3 from hemagglutinin__InfluenzaB__AHL94274
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaauaaaacucagaugaagucucuguauggcgauagcaacccucaaaaguuuacauccucagcgaauggggugaccacgcacuacgucagucagaucggagacuucccagaucagaccgaggacggcggucucccccagagcgggagaauaguuguggauuauaugaugcaaaaaccuggaaagacaggcacuauuguauaccagaggggcguguuacugccacagaaagucuggugcgcaucugggcgguccaaggugaucaaaggaucacuucccuugauuggugaagccgacugucugcaugaggaauacggcgggcuaaacaagagcaaaccguauuacaccggaaagcacgcuaaggccaucggcaauugcccuaucuggguuaaaacaccccucaagcuggcaaacgguacuaaauaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaagucuacacaggaggccaucaacaagauuaccaaaaaucugaacuccuuaagcgaacuggaggugaagaaucuccaaagacuuucgggcgcaauggaugaacugcauaacgagaucuuggagcuagacgaaaaaguagaugaccugagggccgauacuauaucuucccagauugagcucgcuguucugcuuucaaaugaagguaucaucaacagugaggacgaacaccuguuggcgcucgagcggaagcugaaaaagauguuagggcccagcgcaguggauauuggcaauggauguuucgagacgaagcacaaaugcaaccagacaugccuggaccguaucgccgcuggcaccuuuaaugccggggaguucucccuaccaacuuuugauucucucaacauuaccgcagccagccugaaugacgauggacuugacaaccauacaauauugcuguauuacucaaccgcugccaguucccucgcagucacucugaugcuugcgaucuucauuguguauauggucagccgcgacaaugugucuuguucaaucugccuguga

SEQ ID NO: 150146 - RNA, 1755 nt, Artificial Sequence; identical to SEQ ID NO: 150145
  derived and/or modified sequence opt3 from hemagglutinin__InfluenzaB__AHL94295

SEQ ID NO: 150147 - RNA, 1755 nt, Artificial Sequence
  derived and/or modified sequence opt3 from hemagglutinin__InfluenzaB__AHL94306
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugccaccauggcuugggccguaccaaaggacaauuauaaaaacgcgacgaauccgcagacuguugaggugcccuacaucuguacagaaggagaggaucagauuaccgucugggguuuccauuccgacaacaagacucaaaugaaaaaucuguauggcgauucuaacccucagaaguuuacaagcuccgcaaauggggugaccacgcacuacgugucacagaucggagacuucccagaucagaccgaggacggcggucugccccaaagugggagaauagucguugauuauauggugcagaagccuggaaaaacaggcacuauuguauaccagaggggcgugcucuuaccacagaaggucuggugcgccagcgggcggucuaaagugaucaagggaucccugccccuuauuggugaagcugacuguuugcaugagaaauacggcgggcugaacaagucaaaaccguauuacaccggagaacacgccaaggcaaucggcaacugcccuaucuggguuaagacaccccuaaaacucgcuaaugguacuaaguaucgcccuccagccaaacugcuuaaggagcgaggguuuuucggcgcgauugccggauuucuggagggcgggugggaaggaaugauagcagguuggcacggcuacaccagccauggggcucacggaguggccgucgcugccgacuugaaaaguacacaagaggcaaucaacaagauuaccaagaaucucaacucucuguccgaauuagaggugaaaaaucugcagagacucagcggcgccauggaugaacuucauaacgagauccuggaguuggacgaaaagguagaugaccuaagggcugauacuauaucgucucagauugagcuggcgguucuccuguccaaugaagguaucaucaacucagaggacgaacaccuucuggcauuggagcggaaacucaagaaaaugcuggggcccagugccguggauauuggcaauggauguuucgagacgaagcacaagugcaaccaaacaugcuuagaccguaucgcugccggcaccuuuaaugcaggggaguucagccugccaacuuuugauucccuaaacauuaccgccgcuucucucaaugacgauggacuggacaaccauacaauacuuuuguauuacagcaccgccgcaucaagucuggcggucacucucaugcuggcuaucuucauuguguauauggucucccgcgacaaugugagcuguucuaucugccuuuga

SEQ ID NO: 150148 - RNA, 1755 nt, Artificial Sequence
  derived and/or modified sequence opt3 from hemagglutinin__InfluenzaB__AHL94317
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagaguuacuucgcgaaucugaaagguaucaggacucggggcaaguuguguccggauugcuuaaacuguacagaccuggauguggcucuagggcgccccaugugcguuggaaccacgccuagcgccaaagcauccauucuccaugaagugcgaccagucacuucuggcuguuuucccaucaugcacgaccguaccaagauaagacaacugccuaaucuucugagggguuaugagaacauccgguugucgacacagaaugugauugaugccgaaaaggcuccagggggacccuaccgccucggcacuucaggcagcugcccuaacgcaaccaguaaaaucggguucuuugccacaauggcuugggccguaccaagagacaauuauaagaacgcgaccaauccgcagacgguugaggugcccuacauuuguacugaaggagaggaucagaucacagucugggguuuccauuccgacaacaaaacccaaaugaagaaucuguauggcgauucuaacccucagaaauuuacuagcuccgcaaauggggugacaacccacuacgugucacagauaggagacuucccagaucagacggaggacggcggucugccccaaagugggaggauugucguugauuauauggugcagaagccuggaaagaccggcacaaucguauaccagcggggcgugcucuuaccacagaaagucuggugcgccagcgggcgcucuaaggugauuaaaggaucccugccccuuaucggugaagcugacuguuugcaugagaaguacggcgggcugaacaaaucaaagccguauuacacuggagaacacgccaaagcaaucggcaacugcccuauuuggguuaagaccccacuaaagcucgcuaaugguacaaaauaucgacccccugccaagcugcuuaaagagagaggguuuuucggcgcgauagccggauuucuggagggcgggugggaaggaaugaucgcagguuggcacggcuacacuagccauggggcucacggaguggccgucgcugccgacuugaagaguacccaagaggcaauuaacaaaaucacaaagaaucucaacucucuguccgaauuagaggugaagaaucugcagaggcucagcggcgccauggaugaacuucauaacgagauacuggaguuggacgaaaaaguagaugaccuacgggcugauaccauuucgucucagaucgagcuggcgguucuccuguccaaugaagguaucauuaacucagaggacgaacaccuucuggcauuggagcguaagcucaaaaagaugcuggggcccagugccguggauaucggcaauggauguuucgagacuaaacacaagugcaaccaaacgugcuuagaccgcauugcugccggcacauuuaaugcaggggaguucagccugccaaccuuugauucccuaaacauaacugccgcuucucucaaugacgauggacuggacaaccauaccauccuuuuguauuacagcacagccgcaucaagucuggcggucacccucaugcuggcuauuuucaucguguauauggucuccagagacaaugugagcuguucuaucugccuuuga

SEQ ID NO: 150149 - RNA, 1755 nt, Artificial Sequence; identical to SEQ ID NO: 150147
  derived and/or modified sequence opt3 from hemagglutinin__InfluenzaB__AHL94328

SEQ ID NO: 150150 - RNA, 1755 nt, Artificial Sequence; identical to SEQ ID NO: 150145
  derived and/or modified sequence opt3 from hemagglutinin__InfluenzaB__AHL94339

SEQ ID NO: 150151 - RNA, 1758 nt, Artificial Sequence
  derived and/or modified sequence opt3 from hemagglutinin__InfluenzaB__AHL94350
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaacccucagaaguuuacaucuagcgccaacggagugaccacgcacuacgucucccaaauuggcgguuucccaaaucagaccgaggacgggggacugccccagucaggccgcaucguuguggauuauaugguacagaaaaguggcaagacagggacuauuaccuaccaaagaggaauccucuuaccucagaaaguguggugcgcgagcgguaggucuaaggucaucaaaggcucccugccacuuauuggggaagcagacuguuugcaugagaaguauggaggccugaacaaaucaaagcccuacuacacaggugagcacgccaaggcuauagggaauugcccgaucugggugaaaacuccucuaaagcucgccaacggcaccaaauaucggcccccagcaaagcugcuuaaagaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaauaagauuacuaaaaaccucaauucucuguccgaauuagaggucaagaaccugcagcgacucagcggggccauggacgagcuucauaaugaaauccuggaguuggaugaaaaaguggacgaccuaagagcagauacgaucucgucucaaauugagcuggccguacuccuguccaacgaaggcaucauuaauucagaggacgagcaccuucuggcuuuggaaaggaagcucaaaaagaugcugggaccuagugcgguugagauaggcaacggguguuucgaaacaaagcauaaaugcaaucagaccugcuuagaucggaucgcagccggaacuuuugacgcuggugaguucagccugcccaccuuugauucccuaaacauuacagccgcaucucucaaugacgauggccuggacaaccacaccauccuuuuguauuacagcacugccgcuucaagucuggccgugacacucaugaucgcaauuuucgucguguauauggucuccaaggauaacgugagcuguucuauaugccuguga

SEQ ID NO: 150152 - RNA, 1758 nt, Artificial Sequence
  derived and/or modified sequence opt3 from hemagglutinin__InfluenzaB__AHL94361
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaacccucagaaguuuacaucuagcgccaacggagugaccacgcacuacgucucccaaauuggcgguuucccaaaucagaccgaggacgggggacugccccagucaggccgcaucguuguggauuauaugguacagaaaaguggcaagacagggacuauugcguaccaaagaggaauccucuuaccucagaaaguguggugcgcaagcgguaggucuaaggucaucaaaggcucccugccacuuauuggggaagccgacuguuugcaugagaaguauggaggccugaacaaaucaaagcccuacuacaccggugagcacgcuaaggccauagggaauugcccgaucugggugaaaacaccucuaaagcucgcaaacggcacuaaauaucggcccccagcuaagcugcuuaaagaacgcggauuuuucggcgccauugcgggguuucuggagggagguugggaaggcaugaucgccggguggcauggauacaccagccacggcgcacacgguguugcuguggccgcugauuugaagaguacacaggaggccauaaauaagauuaccaaaaaccucaauucucuguccgaauuagaggucaagaaccugcagcgacucagcggggcaauggacgagcuucauaaugaaauccuggaguuggaugaaaaaguggacgaccuaagagccgauacuaucucgucucaaauugagcuggcuguacuccuguccaacgaaggcaucauuaauucagaggacgagcaccuucuggcguuggaaaggaagcucaaaaagaugcugggaccuagugcaguugagauaggcaacggguguuucgaaacgaagcauaaaugcaaucagacaugcuuagaucggaucgccgcuggaaccuuugacgccggugaguucagccugcccacuuuugauucccuaaacauuaccgcagccucucucaaugacgauggccuggacaaccacacaauccuuuuguauuacagcaccgcugccucaagucuggcagugacucucaugaucgcgauuuucgucguguauauggucucccgugauagcgugucuuguucaauaugccuguga

SEQ ID NO: 150153 - RNA, 1758 nt, Artificial Sequence
  derived and/or modified sequence opt3 from hemagglutinin__InfluenzaB__AHL94383
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggagaagcuguauggggauuccaagccucagaaauuuacaucuagcgcuaacggagugaccacgcacuacgucucccaaauuggcgguuucccaaaccagaccgaagacgggggacugccccagucaggccgcaucguuguggauuauaugguacagaagaguggcaaaacagggacuauuaccuaccaaagaggaauccucuuaccucagaagguguggugcgccagcgguaggucuaaagucaucaagggcucccugccacuuauuggggaggcggacuguuugcaugagaaauauggaggccugaauaagucaaagcccuacuacacaggugaacacgcaaaagccauagggaacugcccgaucugggugaagacuccucuaaaacucgcuaauggcaccaaguaucggcccccagccaaacugcuuaaggagcgcggauuuuucggcgcaauugcuggguuucuggaaggagguugggagggcaugaucgccggguggcauggauacacaagccacggcgcgcacgguguugccguggcagcugauuugaagaguacccaggaagccauaaacaaaauuacuaagaaucucaacucucuguccgaguuagaggucaaaaaucugcagcgacucagcggggcuauggacgaacuucauaacgagauccuggaauuggaugagaagguggacgaccuaagagccgauacgaucucgucucaaauugaacuggcaguacuccuguccaaugagggcaucauuaacucagaggacgaacaccuucuggccuuggagaggaaacucaagaagaugcugggaccuagugcuguugaaauaggcaauggguguuucgagacaaaacauaagugcaaccagaccugcuuagaucggaucgcggcaggaacuuuugacgccggugaguucagccugcccaccuuugauucccuaaauauuacagcugccucucucaacgacgauggccuggacaaucacaccauccuuuuguauuacagcacugcagccucaagucuggcugugacacucaugaucgccauuuucgucguguauauggucucccgugauaacgugagcuguucuauaugccuguga

SEQ ID NO: 150154 - RNA, 1758 nt, Artificial Sequence; identical to SEQ ID NO: 148661
  derived and/or modified sequence opt3 from hemagglutinin__InfluenzaB__AHL94394

SEQ ID NO: 150155 - RNA, 1758 nt, Artificial Sequence
  derived and/or modified sequence opt3 from hemagglutinin__InfluenzaB__AHL94405
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuuaaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaacgugagcuguucuauaugccuguga

SEQ ID NO: 150156 - RNA, 1758 nt, Artificial Sequence; identical to SEQ ID NO: 148661
  derived and/or modified sequence opt3 from hemagglutinin__InfluenzaB__AHL94416

SEQ ID NO: 150157 - RNA, 1755 nt, Artificial Sequence; identical to SEQ ID NO: 148870
  derived and/or modified sequence opt3 from hemagglutinin__InfluenzaB__AHL94427

SEQ ID NO: 150158 - RNA, 1755 nt, Artificial Sequence
  derived and/or modified sequence opt3 from hemagglutinin__InfluenzaB__AHL94438
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugagaccauggccugggcuguaccaaaggacaauuauaaaaacgccacgaauccgcagacuguugaagugcccuacaucuguacagagggagaggaucagauuaccgucugggguuuccauuccgacaacaagacucaaaugaaaaaucuguauggcgauucuaacccucagaaguuuacaagcuccgcgaauggggugaccacgcacuacgugucacagaucggagacuucccagaucagaccgaagacggcggucugccccaaagugggagaauagucguugauuauauggugcagaagccuggaaaaacaggcacuauuguauaccagaggggcgugcucuuaccacagaaggucuggugcgcaagcgggcggucuaaagugaucaagggaucccugccccuuauuggugaggccgacuguuugcaugaaaaauacggcgggcugaacaagucaaaaccguauuacaccggagagcacgcuaaggccaucggcaacugcccuaucuggguuaagacaccccuaaaacucgcaaaugguacuaaguaucgcccuccagcuaaacugcuuaaggagcgaggguuuuucggcgccauugcgggauuucuggaaggcgggugggagggaaugauagccgguuggcacggcuacaccagccauggggcacacggaguggcugucgccgcugacuugaaaaguacacaagaagccaucaacaagauuaccaagaaucucaacucucuguccgaguuagaagugaaaaaucugcagagacucagcggcgcaauggaugagcuucauaacgagauccuggaauuggacgagaagguagaugaccuaagggccgauacuauaucgucucagauugaacuggcuguucuccuguccaaugaggguaucaucaacucagaagacgagcaccuucuggcguuggagcggaaacucaagaaaaugcuggggcccagugcaguggauauuggcaauggauguuucgaaacgaagcacaagugcaaccaaacaugcuuagaccguaucgccgcuggcaccuuuaaugccggggaguucagccugccaacuuuugauucccuaaacauuaccgcagccucucucaaugacgauggacuggacaaccauacaauacuuuuguauuacagcaccgcugccucaagucuggcagucacucucaugcuggcgaucuucauuguguauauggucucccgcgacaaugugagcuguucuaucugccuuuga

SEQ ID NO: 150159 - RNA, 1755 nt, Artificial Sequence
  derived and/or modified sequence opt3 from hemagglutinin__InfluenzaB__AHL94460
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugccaccauggcuugggccguaccaaaggacaauuauaaaaacgcgacgaauccgcagacuguugaggugcccuacaucuguacagaagaggaggaucagauuaccgucuggggauuccauuccgacaacaagacucaaaugaaaaaucuguauggugauucuaacccucagaaguuuacaagcuccgcaaauggcgugaccacgcacuacgugucacagaucggggacuucccagaucagaccgaagacggaggccugccccaaagugguagaauagucguugauuauauggugcagaagccugggaaaacaggaacuauuguauaccagaggggcgugcucuuaccacagaaggucuggugcgccagcggccggucuaaagugaucaaggggucccugccccuuauuggagaggcugacuguuugcaugaaaaauacgguggccugaacaagucaaaaccguauuacaccggggagcacgccaaggcaaucggaaacugcccuaucuggguuaagacaccccuaaaacucgcuaauggcacuaaguaucgcccuccagccaaacugcuuaaggagcgaggguuuuucggugcgauugccggcuuucuggaaggaggcugggaggggaugauagcaggauggcacgguuacaccagccauggcgcucacgggguggccgucgcugccgacuugaaaaguacacaagaagcaaucaacaagauuaccaagaaucucaacucucuguccgaguuagaagugaaaaaucugcagagacucagcggagccauggaugagcuucauaacgagauccuggaauuggacgagaagguagaugaccuaagggcugauacuauaucgucucagauugaacuggcgguucuccuguccaaugagggcaucaucaacucagaagacgagcaccuucuggcauuggagcggaaacucaagaaaaugcugggucccagugccguggauauugggaauggcuguuucgaaacgaagcacaagugcaaccaaacaugcuuagaccguaucgcugccggaaccuuuaaugcaggcgaguucagccugccaacuuuugauucccuaaacauuaccgccgcuucucucaaugacgaugggcuggacaaccauacaauacuuuuguauuacagcaccgccgcaucaagucuggcggucacucucaugcuggcuaucuucauuguguauauggucucccgcgacaaugugagcuguucuaucugccuuuga

SEQ ID NO: 150160 - RNA, 1755 nt, Artificial Sequence
  derived and/or modified sequence opt3 from hemagglutinin__InfluenzaB__AHL94471
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcugacuguggagguccccuacaucuguacagaaggagaggaucagauuaccgugugggguuuccauuccgacaauaaaacucagaugaagucucuguauggcgauagcaacccucaaaaguuuacauccucagcgaauggggugaccacgcacuacgucagucagaucggagacuucccagaucagaccgaggacggcggucucccccagagcgggagaauaguuguggauuauaugaugcaaaaaccuggaaagacaggcacuauuguauaccagaggggcguguuacugccacagaaagucuggugcgcaucugggcgguccaaggugaucaaaggaucacuucccuugauuggugaagccgacugucugcaugaggaauacggcgggcuaaacaagagcaaaccguauuacaccggaaagcacgcuaaggccaucggcaauugcccuaucuggguuaaaacaccccucaagcuggcaaacgguacuaaauaucgcccuccagcuaaacuucugaaggagcgaggguuuuucggcgccauugcgggauuuuuggagggcgggugggaaggaaugauagccgguuggcacggcuacaccagucauggggcacacggaguggcugucgccgcugaccucaagucuacacaggaggccaucaacaagauuaccaaaaaucugaacuccuuaagcgaacuggaggugaagaaucuccaaagacuuucgggcgcaauggaugaacugcauaacgagaucuuggagcuagacgaaaaaguagaugaccugagggccgauacuauaucuucccagauugagcucgcuguucugcuuucaaaugaagguaucaucaacagugaggacgaacaccuguuggcgcucgagcggaagcugaaaaagauguuagggcccagcgcaguggauauuggcaauggauguuucgagacgaagcacaaaugcaaccagacaugccuggaccguaucgccgcuggcaccuuuaaugccggggaguucucccuaccaacuuuugauucucucaacauuaccgcagccagccugaaugacgauggacuugacaaccauacaauauugcuguauuacucaaccgcugccaguucccucgcagucacucugaugcuugcgaucuucauuguguauauggucagccgcgacaauaucucuuguucaaucugccuguga

SEQ ID NO: 150161 - RNA, 1758 nt, Artificial Sequence
  derived and/or modified sequence opt3 from hemagglutinin__InfluenzaB__AHL94482
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuuacaaccauggccugggcugugccgaaaaacgacaagaauaaaacggcaacuaacccacucacaauugaaguccccuacaucuguaccgagggugaggaucagauaacuguguggggcuuccacagugacaaugaaacacagauggccaagcuguauggggauuccaagccucagaaauuuaccucuagcgcuaacggagugacgacccacuacgucucccaaauuggcgguuucccaaaccagacagaggacgggggacugccccagucaggccgcaucguuguggauuauaugguacagaagaguggcaaaacugggaccauuacauaccaaagaggaauccucuuaccucagaagguguggugcgccagcgguaggucuaaagucaucaagggcucccugccacuuauuggggaagcggacuguuugcaugagaaauauggaggccugaauaagucaaagcccuacuacacuggugagcacgcaaaagccauagggaacugcccgaucugggugaagaccccucuaaaacucgcuaauggcacaaaguaucggcccccagccaaacugcuuaaggaacgcggauuuuucggcgcaauugcuggguuucuggagggagguugggaaggcaugaucgccggguggcauggauacaccagccacggcgcgcacgguguugccguggcagcugauuugaagaguacucaggaggccauaaacaaaauuacgaagaaucucaacucucuguccgaauuagaggucaaaaaucugcagcgacucagcggggcuauggacgagcuucauaacgaaauccuggaguuggaugaaaagguggacgaccuaagagccgauacaaucucgucucaaauugagcuggcaguacuccuguccaaugaaggcaucauuaacucagaggacgagcaccuucuggccuuggaaaggaaacucaagaagaugcugggaccuagugcuguugagauaggcaauggguguuucgaaaccaaacauaagugcaaccagacuugcuuagaucggaucgcggcaggaaccuuugacgccggugaguucagccugcccacauuugauucccuaaauauuaccgcugccucucucaacgacgauggccuggacaaucacacuauccuuuuguauuacagcacagcagccucaagucuggcugugacgcucaugaucgccauuuucgucguguauauggucucccgugauaacgugagcuguucuauaugccuguga

SEQ ID NO: 150162 - RNA, 1755 nt, Artificial Sequence; identical to SEQ ID NO: 150145
  derived and/or modified sequence opt3 from hemagglutinin__InfluenzaB__AHL94493

SEQ ID NO: 150163 - RNA, 1755 nt, Artificial Sequence; identical to SEQ ID NO: 150147
  derived and/or modified sequence opt3 from hemagglutinin__InfluenzaB__AHL94504

SEQ ID NO: 150164 - RNA, 1758 nt, Artificial Sequence
  derived and/or modified sequence opt3 from hemagglutinin__InfluenzaB__AHL94515
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacauauaacguaauuaaugccgaggacgcaccagggggacccuacaagaucggcacuucaggcagcugcccuaacguuaccaaugggaacggauucuuugccacaauggcuugggcagugccgaaaaaugauaagaacaaaaccgccacgaauccacucacuauugaaguccccuauaucuguacagagggugaggaccagauaaccguguggggcuuccauagugauaacgaaacucagauggagaagcuguacggggacuccaagccucagaaauuuacaucuagcgcuaauggagugaccacgcacuaugucucccaaauuggcgguuucccaaaccagaccgaagaugggggacugccccagucaggccgcaucguuguggacuacaugguacagaagaguggcaaaacagggacuauuaccuaucaaagaggaauccucuuaccucagaagguguggugcgccagcgguaggucuaaagucaucaagggcucccugccacuuauuggggaggcggauuguuugcacgagaaauacggaggccugaacaagucaaagcccuacuauacaggugaacaugcaaaagccauagggaauugcccgaucugggugaagacuccucuaaaacucgcuaacggcaccaaguaccggcccccagccaaacugcuuaaggagcgcggauuuuucggcgcaauugcuggguuucuggaaggagguugggagggcaugaucgccggguggcacggauauacaagccauggcgcgcacgguguugccguggcagcugacuugaagaguacccaggaagccauaaauaaaauuacuaagaaccucaauucucuguccgaguuagaggucaaaaaccugcagcgacucagcggggcuauggaugaacuucacaaugagauccuggaauuggacgagaagguggacgaucuaagagccgacacgaucucgucucaaauugaacuggcaguacuccuguccaacgagggcaucauuaauucagaggaugaacaucuucuggccuuggagaggaaacucaagaagaugcugggaccuagugcuguugaaauaggcaacggguguuucgagacaaaacacaagugcaaucagaccugcuuagaccggaucgcggcaggaacuuuugaugccggugaguucagccugcccaccuuugacucccuaaacauuacagcugccucucucaaugaugacggccuggauaaccauaccauccuuuuguacuauagcacugcagccucaagucuggcugugacacucaugaucgccauuuucgucguguacauggucucccgugacaaugugagcuguucuauaugccuguga

SEQ ID NO: 150165 - RNA, 1755 nt, Artificial Sequence; identical to SEQ ID NO: 150147
  derived and/or modified sequence opt3 from hemagglutinin__InfluenzaB__AHL94526

SEQ ID NO: 150166 - RNA, 1758 nt, Artificial Sequence
  derived and/or modified sequence opt3 from hemagglutinin__InfluenzaB__AHL94537
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaacccucagaaguuuacaucuagcgccaacggagugaccacgcacuacauuucccaaaucggcgguuucccaaaucagaccgaggacgggggacugccccagucaggccgcauugucguugauuauauggugcagaaaaguggcaagacagggacuaucaccuaccaaagaggaauccucuuaccucagaaaguauggugcgcgagcgguaggucuaaggugauuaaaggcucccugccacuuauaggggaagcagacuguuugcaugagaaguauggaggccugaacaaaucaaagcccuacuacacaggugagcacgccaaggcuaucgggaauugcccgauuugggucaaaacuccucuaaagcucgccaacggcaccaaauaucggcccccagcaaagcugcuuaaagaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaauaagaucacuaaaaaccucaauucucuguccgaauuagaggugaagaaccugcagcgacucagcggggccauggacgagcuucauaaugaaauccuggaguuggaugaaaaagucgacgaccuaagagcagauacgauuucgucucaaaucgagcuggccgugcuccuguccaacgaaggcauuauaaauucagaggacgagcaccuucuggcuuuggaaaggaagcucaaaaagaugcugggaccuagugcgguagagaucggcaacggguguuucgaaacaaagcauaaaugcaaucagaccugcuuagaucggauugcagccggaacuuuugacgcuggugaguucagccugcccaccuuugauucccuaaacaucacagccgcaucucucaaugacgauggccuggacaaccacaccauccuuuuguauuacagcacugccgcuucaagucuggccguuacacucaugauugcaauauucguggucuauauggugucccgugauaacgucagcuguucuaucugccuguga

SEQ ID NO: 150167 - RNA, 1755 nt, Artificial Sequence
  derived and/or modified sequence opt3 from hemagglutinin__InfluenzaB__AHL94548
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaucaagaguuacuucgccaaucugaaagguaccaagacuaggggcaaauuguguccggauugcuuaaacuguacagaccuggauguugcgcuagggcggcccaugugcgugggaaccacgccuagcgcuaaggccuccauucuccaugaaguccgcccagugacuucuggcuguuuucccaucaugcacgaccgaaccaagauacgucaacuggcaaaucuucugagagguuaugagaacaucagguugucgacacagaauguaauugaugccgaacgggcuccugggggaccauaccgccucggcacuucaggcagcugccccaacgcaaccaguaaauccggguucuuugccacaauggcuugggccguuccuaaggacaauaacaaaaaugcgaccaacccacugacgguggaggucccguauaucugugcagaaggagaggaucagauuacugugugggguuuccauucugacaauaagacacagaugaaaaaccuguacggcgauagcaauccccaaaaguuuaccuccucagccaacggggugacuacacacuaugucagucagaucggaggcuucccugaccagaccgaggauggugggcucccacagagcggaagaauaguuguggacuacaugaugcaaaagcccggcaaaacgggcaccauuguauaucagcgcgggguguuacugccucagaaggucuggugcgcuucuggacgguccaaagugaucaaggguucacuuccauugauuggcgaagccgauugucugcaugagaaauacgggggacuaaacaagagcaaacccuacuauacaggcgaacacgcaaaggcuaucgguaauugcccgaucuggguuaagacuccucucaaacuggccaacgggaccaaguacaggcccccagcgaaacuucugaaggagcgaggcuuuuucggagccauugcaggcuuuuuggaagggggaugggaagguaugauagcuggcuggcacggguauacaagucauggagcccacggcguggcugucgccgcagaccucaaaucuacucaggaggccaucaauaagauuaccaagaacuuaaauucccugagcgaacuggaggugaaaaaccuccaaagacuuucgggugcuauggacgaacugcauaaugagaucuuggagcuagaugaaaagguagacgaucugagggcggacacaauaucuucccagauugagcucgcaguucugcuuucaaacgaagggaucaucaauagugaggaugaacaccuguuggcccucgagcggaaacugaagaaaauguuaggcccuagcgcuguggacauuggaaacggcuguuucgagaccaagcacaagugcaaucagacuugccuggaucguaucgccgcagggacguuuaacgccggagaguucucccuacccacauuugacucucucaauauuaccgcugccagccugaacgaugacggucuugauaaucauacuauauugcuguacuauucaaccgcagcgaguucccucgcugucacacugaugcuugccaucuucauuguguacauggucagccgcgacaacgugucuuguucaaucugccuguga

SEQ ID NO: 150168 - RNA, 1755 nt, Artificial Sequence; identical to SEQ ID NO: 150145
  derived and/or modified sequence opt3 from hemagglutinin__InfluenzaB__AHL94559

SEQ ID NO: 150169 - RNA, 1755 nt, Artificial Sequence; identical to SEQ ID NO: 148870
  derived and/or modified sequence opt3 from hemagglutinin__InfluenzaB__AHL94570

SEQ ID NO: 150170 - RNA, 1755 nt, Artificial Sequence; identical to SEQ ID NO: 148870
  derived and/or modified sequence opt3 from hemagglutinin__InfluenzaB__AHL94581

SEQ ID NO: 150171 - RNA, 1755 nt, Artificial Sequence; identical to SEQ ID NO: 148870
  derived and/or modified sequence opt3 from hemagglutinin__InfluenzaB__AHL94592

SEQ ID NO: 150172 - RNA, 1758 nt, Artificial Sequence
  derived and/or modified sequence opt3 from hemagglutinin__InfluenzaB__AHL94603
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaaaacauccgguugucgacacacaauguaauuaacgccgagaaugcaccagggggacccuauaagaucggcacuucaggcagcugcccuaacguuaccaaugggaacggauucuuugccacaauggcuugggcagugccgaaaaaugacaagaacaaaaccgccacgaauccacucacuauugaaguccccuacaucuguacagagggugaggaucagauaaccguguggggcuuccauagugacaacgaaacucagauggcuaagcuguauggggauuccaagccucagaaauuuacaucuagcgccaacggagugaccacgcacuacgucucccaaauuggcgguuucccaaaucagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcacgagaaauauggaggccugaacaagucaaagcccuacuacacaggugagcaugccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcacggauacacaagccauggcgcccacgguguugcaguggcugccgauuugaagaguacccaggaggcuauaaauaaaauuacuaagaaccucaauucucuguccgaauuagaggucaaaaaccugcagcgacucagcggggccauggacgagcuucacaaugaaauccuggaguuggaugaaaagguggacgaccuaagagcagauacgaucucgucucaaauugagcuggccguacuccuguccaacgaaggcaucauuaauucagaggacgagcaucuucuggcuuuggaaaggaaacucaagaagaugcugggaccuagugcgguugagauaggcaacggguguuucgaaacaaaacacaagugcaaucagaccugcuuagaucggaucgcagccggaacuuuugacgcuggugaguucagccugcccaccuuugauucccuaaacauuacagccgcaucucucaaugacgauggccuggacaaccauaccauccuuuuguauuacagcacugccgcuucaagucuggccgugacacucaugaucgcaauuuucgucguguauauggucucccgugauaacgugagcuguucuauaugccuguga

SEQ ID NO: 150173 - RNA, 1758 nt, Artificial Sequence
  derived and/or modified sequence opt3 from hemagglutinin__InfluenzaB__AHL94614
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacauaagccacggcgcccacgguguugcaguggcugccgauuugaagaguacacaggaggcuauuaacaaaaucaccaagaaucucaacucucuguccgaauuagaggucaaaaaucugcagcgacucagcggggccauggacgagcuucauaacgaaauccuggaguuggaugaaaagguggacgaccuaagagcagauacuauuucgucucaaaucgagcuggccguacuccuguccaaugaaggcauuauaaacucagaggacgagcaccuucuggcuuuggaaaggaaacucaagaagaugcugggaccuagugcgguugagaucggcaauggguguuucgaaacgaaacauaagugcaaccagacaugcuuagaucggauugcagccggaaccuuugacgcuggugaguucagccugcccacuuuugauucccuaaauaucaccgccgcaucucucaacgacgauggccuggacaaucacacaauccuuuuguauuacagcaccgccgcuucaagucuggccgugacucucaugauugcaauauucgucguguauauggucucccgugauaacgugagcuguucuaucugccuguga

SEQ ID NO: 150174 - RNA, 1755 nt, Artificial Sequence; identical to SEQ ID NO: 150147
  derived and/or modified sequence opt3 from hemagglutinin__InfluenzaB__AHL94624

SEQ ID NO: 150175 - RNA, 1758 nt, Artificial Sequence
  derived and/or modified sequence opt3 from hemagglutinin__InfluenzaB__AHL94646
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugccucaauguuaccaacgggaauggauucuuugccacaauggcuugggcagugccuaaaaacgacaagaauaaaaccgccacgaacccacugacuauugaagucccguacaucuguacagagggugaggaucagauaaccguguggggcuuccacagugacaaugaaacucagauggcuaagcuguauggggauuccaagccccagaaauuuacaucuagcgccaacggagugaccacgcacuacgucucccaaauuggcgguuucccuaaccagaccgaggacgggggacucccacagucaggccgcaucguuguggauuauaugguacagaagaguggcaaaacagggacuauuaccuaccaaagaggaaucuuacugccccagaagguguggugcgcgagcgguaggucuaaagucaucaagggcucccuuccuuugauuggggaagcagacugucugcaugagaaauauggaggccuaaauaagucaaagccauacuacacaggugagcacgccaaagcuauagggaacugccccaucugggugaagacuccgcucaaacuggccaauggcaccaaguaucggccucccgcaaaacuucugaaggaacgcggauuuuucggcgcuauugccggguuuuuggagggagguugggaaggcaugaucgcgggguggcauggauacacaagccacggcgcccacgguguugcaguggcugccgaucucaagaguacccaggaggcuauaaacaaaauuacuaagaaucugaacucuuuauccgaacuggaggucaaaaaucuccagcgacuuagcggggccauggacgagcugcauaacgaaaucuuggagcuagaugaaaagguggacgaccugagagcagauacgaucucgucucaaauugagcucgccguacugcuuuccaaugaaggcaucauuaacucagaggacgagcaccuguuggcucucgaaaggaaacugaagaagauguuaggaccaagugcgguugagauaggcaauggguguuucgaaacaaaacauaagugcaaccagaccugccuggaucggaucgcagccggaacuuuugacgcuggugaguucagccuaccuaccuuugauucccucaauauuacagccgcaucucugaacgacgauggccuugacaaucacaccaucuugcuguauuacagcacugccgcuucaagucucgccgugacacugaugaucgcaauuuucgucguguauauggucucccgugauaacgugagcuguucuauaugccuuuga

SEQ ID NO: 150176 - RNA, 1758 nt, Artificial Sequence
  derived and/or modified sequence opt3 from hemagglutinin__InfluenzaB__AHL94657
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagucagcacccgggggaccuuauaagaucggcacuagcggcaguugcccaaacguuaccaaugggaacggauucuuugccacaauggcuugggcagugccgaaaaaugacaagaacaaaaccgccacggaucccuugacuauugaagucccuuacaucuguacagagggugaggaccagauaaccguguggggcuuccacuccgauaaugaaacucagauggcuaagcucuauggggacucuaagccacagaaauuuacaagcuccgccaacggagugaccacgcacuacgucucacaaauuggcgguuuccccaaucagaccgaggaugggggacugccucagaguggccgcaucguuguggacuauaugguacaaaagagcggcaaaacagggacuauuaccuaccagagaggaauccugcucccacagaagguguggugcgcgucugguagguccaaagucaucaagggcucauuaccccugauuggggaagcagauugucuucaugagaaauauggaggcuugaacaagagcaagccguacuacacaggugagcacgccaaagcuauagggaacugcccuaucugggugaagacuccccugaaacuagccaauggcaccaaguaucggccuccagcaaaacuccugaaggaacgcggauuuuucggcgcuauugccggguuucuugagggagguugggaaggcaugaucgcgggguggcauggauacacaagucacggcgcccacgguguugcaguggcugccgaccugaagucuacccaggaggcuauaaacaaaauuacuaagaauuugaacucccucagcgaacuggaggucaaaaauuuacagcgacugucgggggccauggaugagcuccauaacgaaauccuugagcuggacgaaaagguggacgauuugagagcagacacgaucucuucccaaauugagcuagccguacugcucucaaaugaaggcaucauuaacagugaggaugagcaucugcuugcucuggaaaggaaauugaagaagaugcucggacccagcgcgguugagauaggcaauggguguuucgaaacaaaacacaagugcaaccagaccugccuggaccggaucgcagccggaacuuuugaugcuggugaguucuccuuaccaaccuuugacucucugaauauuacagccgcaagccuaaacgaugacggccucgauaaucacaccauccugcuuuauuacucaacugccgcuaguuccuuggccgugacacugaugaucgcaauuuucgucguguauauggucagccgugacaacgugucuuguucaauaugccucuga

SEQ ID NO: 150177 - RNA, 1755 nt, Artificial Sequence; identical to SEQ ID NO: 150147
  derived and/or modified sequence opt3 from hemagglutinin__InfluenzaB__AHL94668

SEQ ID NO: 150178 - RNA, 1755 nt, Artificial Sequence; identical to SEQ ID NO: 150147
  derived and/or modified sequence opt3 from hemagglutinin__InfluenzaB__AHL94679

SEQ ID NO: 150179 - RNA, 1758 nt, Artificial Sequence; identical to SEQ ID NO: 150172
  derived and/or modified sequence opt3 from hemagglutinin__InfluenzaB__AHL94690

SEQ ID NO: 150180 - RNA, 1758 nt, Artificial Sequence
  derived and/or modified sequence opt3 from hemagglutinin__InfluenzaB__AHL94701
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacacugaccaagagucauuucgccaauuugaaagguacugaaacaaggggcaaguuauguccaaaaugccugaacuguaccgaucuagacguugcgcucgggcggccgaagugcacgggaaagauccccagcgcucgcguguccauucugcacgagguccgaccugugacuucuggcuguuuuccaaucaugcaugaucguaccaaaauaagacaacuucccaaucuguugagggguuacgaacacauccggcucucgacacauaacguaauuaaugccgagaacgcaccugggggaccauauaagaucggcacuucaggcagcugccugaauguuaccaacgggaauggauucuuugccacaauggcuugggcagugcccaaaaacgacaagaauaaaaccgccacgaacccucugacuauugaagucccauacaucuguacagagggugaggaucagauaaccguguggggcuuccacagugacaaugaaacucagauggcuaagcucuauggggauuccaagccgcagaaauuuacaucuagcgccaacggagugaccacgcacuacgucucccaaauuggcgguuuccccaaccagaccgaggacgggggauuaccucagucaggccgcaucguuguggauuauaugguacagaagaguggcaaaacagggacuauuaccuaccaaagaggaauccugcuuccacagaagguguggugcgcgagcgguaggucuaaagucaucaagggcuccuugccccugauuggggaagcagacugucuacaugagaaauauggaggccucaauaagucaaagccuuacuacacaggugagcacgccaaagcuauagggaacugcccaaucugggugaagacuccccugaaacuugccaauggcaccaaguaucggccgccugcaaaacuguugaaggaacgcggauuuuucggcgcuauugccggguuucucgagggagguugggaaggcaugaucgcgggguggcauggauacacaagccacggcgcccacgguguugcaguggcugccgaucugaagaguacccaggaggcuauaaacaaaauuacuaagaauuuaaacucucuguccgaacucgaggucaaaaaucuucagcgacugagcggggccauggacgaguugcauaacgaaauccuagagcuggaugaaaagguggacgaccucagagcagauacgaucucgucucaaauugagcuggccguacuucuguccaaugaaggcaucauuaacucagaggacgagcacuugcucgcucuggaaaggaaauuaaagaagaugcugggacccagugcgguugagauaggcaauggguguuucgaaacaaaacauaagugcaaccagaccugccuagaucggaucgcagccggaacuuuugacgcuggugaguucagccucccaaccuuugauucccugaauauuacagccgcaucucuuaacgacgauggcuuggacaaucacaccauccugcucuauuacagcacugccgcuucaagucuggccgugacacuuaugaucgcaauuuucgucguguauauggucucccgugauaacgugagcuguucuauaugccuguga

SEQ ID NO: 150181 - RNA, 1755 nt, Artificial Sequence; identical to SEQ ID NO: 150145
  derived and/or modified sequence opt3 from hemagglutinin__InfluenzaB__AHL94712

SEQ ID NO: 150182 - RNA, 1758 nt, Artificial Sequence; identical to SEQ ID NO: 150176
  derived and/or modified sequence opt3 from hemagglutinin__InfluenzaB__AHL94723

SEQ ID NO: 150183 - RNA, 1755 nt, Artificial Sequence; identical to SEQ ID NO: 150145
  derived and/or modified sequence opt3 from hemagglutinin__InfluenzaB__AHL94734

SEQ ID NO: 150184 - RNA, 1758 nt, Artificial Sequence
  derived and/or modified sequence opt3 from hemagglutinin__InfluenzaB__AHL94745
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugccucaauguuaccaacgggaauggauucuuugccacaauggcuugggcagugccuaaaaacgacaagaauaaaaccgccacgaacccacugacuauugaagucccguacaucuguacagagggugaggaucagauaaccguguggggcuuccacagugacaaugaaacucagauggcuaagcuguauggggauuccaagccccagaaauuuacaucuagcgccaacggagugaccacgcacuacgucucccaaauuggcgguuucccuaaccagaccgaggacgggggacucccacagucaggccgcaucguuguggauuauaugguacagaagaguggcaaaacagggacuauuaccuaccaaagaggaaucuuacugccccagaagguguggugcgcgagcgguaggucuaaagucaucaagggcucccuuccuuugauuggggaagcagacugucugcaugagaaauauggaggccuaaauaagucaaagccauacuacacaggugagcacgccaaagcuauagggaacugccccaucugggugaagacuccgcucaaacuggccaauggcaccaaguaucggccucccgcaaaacuucugaaggaacgcggauuuuucggcgcuauugccggguuuuuggagggagguugggaaggcaugaucgcgggguggcauggauacacaagccacggcgcccacgguguugcaguggcugccgaucucaagaguacccaggaggcuauaaacaaaauuacuaagaaucugaacucuuuauccgaacuggaggucaaaaaucuccagcgacuuagcggggccauggacgagcugcauaacgaaaucuuggagcuagaugaaaagguggacgaccugagagcagauacgaucucgucucaaauugagcucgccguacugcuuuccaaugaaggcaucauuaacucagaggacgagcaccuguuggcucucgaaaggaaacugaagaagauguuaggaccaagugcgguugagauaggcaauggguguuucgaaacaaaacauaagugcaaccagaccugccuggaucggaucgcagccggaacuuuugacgcuggugaguucagccuaccuaccuuugauucccucaauauuacagccgcaucucugaacggcgacgggcuugauaaucacaccaucuugcuguauuacagcacugccgcuucaagucucgccgugacacugaugaucgcaauuuucgucguguauauggucucccgugacaacgugagcuguucuauaugccuuuga

SEQ ID NO: 150185 - RNA, 1755 nt, Artificial Sequence; identical to SEQ ID NO: 148870
  derived and/or modified sequence opt3 from hemagglutinin__InfluenzaB__AHL94756

SEQ ID NO: 150186 - RNA, 1758 nt, Artificial Sequence; identical to SEQ ID NO: 150175
  derived and/or modified sequence opt3 from hemagglutinin__InfluenzaB__AHL94766

SEQ ID NO: 150187 - RNA, 1755 nt, Artificial Sequence
  derived and/or modified sequence opt3 from hemagglutinin__InfluenzaB__AHL94777
augaaggccaucauugugcugcucauggucguuaccagcaacgcugacagaauaugcacaggcaucacuuccucuaauucaccccacgugguaaaaacggcaacccagggggaggugaacgucacaggagccauuccucuuacuaccacaccaaccaagaguuacuucgcgaaucugaaagguacuaggacacggggcaaguuguguccggauugcuuuaacuguaccgacuuagauguggcucuggggcgccccaugugcguuggaacgacuccuagcgccaaagcauccauccuacaugaagugcgaccagucaccucuggcuguuuccccauuaugcacgaccguacaaagaucagacaacucccuaaucugcuuagggguuaugagaacauacggcugucgacucagaaugccaucgaugcugaaaaggcaccagggggacccuaccgcuugggcaccucaggcagcugcccuaacgccacaaguaaaauuggguuuuucgcuaccauggccugggcggugccaaaggacaauuauaaaaacgcaacgaauccgcagacuguagagguucccuacaucuguacagaaggagaggaucagauuaccgugugggguuuucauuccgacaacaagacucaaaugaaaaaucucuauggcgauucuaacccucagaaguucacaagcuccgccaauggggucaccacgcacuacgugucacagaucggagacuuuccagaucagaccgaggacggcggucugccccaaagugggagaauaguggucgauuauaugguucagaagccuggaaaaacaggcacuauuguguaccagaggggcguacugcucccacagaagguguggugcgcuagcgggcggucuaaagucaucaagggauccuuaccccugauuggugaagccgacugucuucaugagaaauacggcggguugaacaagucaaaaccguauuacaccggagaacacgcaaaggcuaucggcaacugcccuaucugggugaagacaccccugaaacuagccaaugguacuaaguaucgcccuccagcgaaacuccugaaggagcgaggguucuuuggcgccauugcaggauuccuugagggcgggugggaaggaaugauagcugguuggcacggcuacaccagccauggggcccacggaguugcuguggccgcagaccugaaaaguacacaagaggccaucaacaagauuaccaagaauuugaacucucucuccgaacuggaggucaaaaauuuacagagacugagcggcgcuauggaugaacuccauaacgagauccuugagcuggacgaaaagguggaugacuugagggcggauacuauaucgucucagauugagcuagcaguacugcucuccaaugaagguaucaucaacucagaggacgaacaucugcuugcccuggagcggaaauugaagaaaaugcucgggcccagugcuguugauauuggcaauggauguuuugagacgaagcacaagugcaaccaaacaugccuggaccguaucgccgcaggcaccuucaaugccggggaauuuagcuuaccaacuuucgauucccugaacauuaccgcugccucucuaaaugacgauggacucgacaaccacacaauacugcuuuauuacagcaccgcagcgucaaguuuggcugugacucugaugcucgccaucuucauugucuauauggugucccgcgacaaugucagcuguucuaucugccuguga

SEQ ID NO: 150188 - RNA, 1758 nt, Artificial Sequence; identical to SEQ ID NO: 150172
  derived and/or modified sequence opt3 from hemagglutinin__InfluenzaB__AHL94797

SEQ ID NO: 150189 - RNA, 1755 nt, Artificial Sequence
  derived and/or modified sequence opt3 from hemagglutinin__InfluenzaB__AHL94808
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagaguuacuucgcgaaucugaaagguaucaggacucggggcaaguuguguccggauugcuuaaacuguacagaccuggauguggcucuagggcgccccaugugcguuggaaccacgccuagcgccaaagcauccauucuccaugaagugcgaccagucacuucuggcuguuuucccaucaugcacgaccguaccaagauaagacaacugccuaaucuucugagggguuaugagaacauccgguugucgacacagaaugugauugaugccgaaaaggcuccagggggacccuaccgccucggcacuucaggcagcugcccuaacgcaaccaguaaaaucggguucuuugccacaauggcuugggccguaccaaaggacaauuauaaaaacgcgaccaauccgcagacgguugaggugcccuacauuuguacugaaggagaggaucagaucacagucugggguuuccauuccgacaacaagacccaaaugaaaaaucuguauggcgauucuaacccucagaaguuuacuagcuccgcaaauggggugacaacccacuacgugucacagauaggagacuucccagaucagacggaggacggcggucugccccaaagugggagaauugucguugauuauauggugcagaagccuggaaaaaccggcacaaucguauaccagaggggcgugcucuuaccacagaaggucuggugcgccagcgggcggucuaaagugauuaagggaucccugccccuuaucggugaagcugacuguuugcaugagaaauacggcgggcugaacaagucaaaaccguauuacacuggagaacacgccaaggcaaucggcaacugcccuauuuggguuaagaccccucuaaaacucgcuaaugguacaaaguaucgcccacccgccaaacugcuuaaggagcgaggguuuuucggcgcgauagccggauuucuggagggcgggugggaaggaaugaucgcagguuggcacggcuacacuagccauggggcucacggaguggccgucgcugccgacuugaaaaguacccaagaggcaauuaacaagaucacaaagaaucucaacucucuguccgaauuagaggugaaaaaucugcagagacucagcggcgccauggaugaacuucauaacgagauacuggaguuggacgaaaagguagaugaccuaagggcugauaccauuucgucucagaucgagcuggcgguucuccuguccaaugaagguaucauuaacucagaggacgaacaccuucuggcauuggagcggaaacucaagaaaaugcuggggcccagugccguggauaucggcaauggauguuucgagacuaagcacaagugcaaccaaacgugcuuagaccguauugcugccggcacauuuaaugcaggggaguucagccugccaaccuuugauucccuaaacauaacugccgcuucucucaaugacgauggacuggacaaccauaccauccuuuuguauuacagcacagccgcaucaagucuggcggucacccucaugcuggcuauuuucaucguguauauggucucccgcgacaaugugagcuguucuaucugccuuuga

SEQ ID NO: 150190 - RNA, 1755 nt, Artificial Sequence
  derived and/or modified sequence opt3 from hemagglutinin__InfluenzaB__AHL94817
augaaggccaucauugugcugcucauggucguuaccagcaacgcugacagaauaugcacaggcaucacuuccucuaauucaccccacgugguaaaaacggcaacccagggggaagugaacgucacaggagccauuccucuuacuaccacaccaaccaagaguuacuucgcgaaucugaaagguacuaggacacggggcaaguuguguccggauugcuuaaacuguaccgaccuggauguggcucuagggcgccccaugugcguuggaacgacuccuagcgccaaagcauccauccuccaugaagugcgaccagucaccucuggcuguuuucccauuaugcacgaccguacaaagaucagacaacugccuaaucuucugagggguuaugagaacauacgguugucgacucagaaugugaucgaugccgaaaaggcuccagggggacccuaccgccucggcaccucaggcagcugcccuaacgcaacaaguaaaauuggguucuuugccaccauggcuugggccguaccaaaggacaauuauaaaaacgcgacgaauccgcagacuguugaggugcccuacaucuguacagaaggagaggaucagauuaccgucugggguuuccauuccgacaacaagacucaaaugaaaaaucuguauggcgauucuaacccucagaaguuuacaagcuccgcaaauggggugaccacgcacuacgugucacagaucggagacuucccagaucagaccgaggacggcggucugccccaaagugggagaauagucguugauuauauggugcagaagccuggaaaaacaggcacuauuguauaccagaggggcgugcucuuaccacagaaggucuggugcgccagcgggcggucuaaagugaucaagggaucccugccccuuauuggugaagcugacuguuugcaugagaaauacggcgggcugaacaagucaaaaccguauuacaccggagaacacgccaaggcaaucggcaacugcccuaucuggguuaagacaccccuaaaacucgcuaaugguacuaaguaucgcccuccagccaaacugcuuaaggagcgaggguuuuucggcgcgauugccggauuucuggagggcgggugggaaggaaugauagcagguuggcacggcuacaccagccauggggcucacggaguggccgucgcugccgacuugaaaaguacacaagaggcaaucaacaagauuaccaagaaucucaacucucuguccgaauuagaggugaaaaaucugcagagacucagcggcgccauggaugaacuucauaacgagaucauagagcuggacgaaaagguagaugacuugagggcugauacuauuucgucucagaucgagcuagcgguucugcucuccaaugaagguaucauuaacucagaggacgaacaucugcuugcacuggagcggaaauugaagaaaaugcucgggcccagugccguggauaucggcaauggauguuucgagacgaagcacaagugcaaccaaacaugccuggaccguauugcugccggcaccuuuaaugcaggggaguucagcuuaccaacuuuugauucccugaacauaaccgccgcuucucuaaaugacgauggacucgacaaccacacaauccugcuuuauuacagcaccgccgcaucaaguuuggcggucacucugaugcucgcuauuuucaucguguauauggucucccgcgacaaugugagcuguucuaucugccuguga

SEQ ID NO: 150191 - RNA, 1758 nt, Artificial Sequence; identical to SEQ ID NO: 149881
  derived and/or modified sequence opt3 from hemagglutinin__InfluenzaB__AHL94827

SEQ ID NO: 150192 - RNA, 1755 nt, Artificial Sequence
  derived and/or modified sequence opt3 from hemagglutinin__InfluenzaB__AHL94837
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccagccaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacugccuaaucuucugagggguuaugagaacauacgguugucgacacagaauguaaucgaugccgaaaaggcuccagggggacccuacaaacucggcacuucaggcagcugcccuaacgcaaccaguaagauuggguucuuugccacaauggcuugggccguuccaaaagacaauuauaagaacgcgaccaauccgcugacgguggagguccccuacaucuguaaagaaggagaggaucagauuacugugugggguuuccauuccgacaacaagacacagaugaagaaucuguauggcgauucuaacccucaaaaauuuaccagcuccgcaaauggggugacuacacacuacgucucacagaucggagacuucccagaucagaccgaggacggcggucucccccagagugggcgcauaguuguggauuauaugaugcaaaagccuggaaaaacgggcaccauuguauaccagagaggcguguuacugccacagaaggucuggugcgccagcgggaggucuaaagugaucaagggaucccuucccuugauuggugaagcugacugucugcaugaggaauacggcgggcuaaacaaaucaaagccguauuacacaggaaagcacgccaaagcaaucggcaacugcccuaucuggguuaagacuccccucaaacuggcuaaugguaccaaguaucggccuccagccaaacuucugaaggagcgcggguuuuucggcgcgauugccggauuuuuggagggcgggugggaaggaaugauagcagguuggcacggcuacacaagccauggggcucacggaguggccgucgcugccgaccucaagaguacucaggaggcaaucaacaaaauuaccaagaaucugaacucuuuauccgaacuggaggugaaaaaucuccaacgacuuagcggcgccauggaugaacugcauaacgagaucuuggagcuagacgaaaagguagaugaccugagagcugauacaauaucgucucagauugagcucgcgguucugcuuuccaaugaagguaucaucaacucagaggacgaacaccuguuggcacucgagaggaaacugaagaagauguuagggcccagugccguggauauuggcaauggauguuucgagaccaaacacaagugcaaccagacuugccuggaccggaucgcugccggcacguuuaaugcaggggaguucagccuaccaacauuugauucccucaacauuaccgccgcuucucugaaugacgauggacuugacaaccauacuauauugcuguauuacagcaccgccgcaucaagucucgcggucacacugaugcuugcuaucuucauuguguauauggucucccgugacaaugugagcuguucuaucugccuguga

SEQ ID NO: 150193 - RNA, 1755 nt, Artificial Sequence; identical to SEQ ID NO: 148870
  derived and/or modified sequence opt3 from hemagglutinin__InfluenzaB__AHL94847

SEQ ID NO: 150194 - RNA, 1758 nt, Artificial Sequence
  derived and/or modified sequence opt3 from hemagglutinin__InfluenzaB__AHL94858
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaauaucccuagcgcucgcguguccauucuccacgagguccgaccagugacuucuggcuguuuucccaucaugcaugaucguaccaagauaagacaacugccuaaccuucugagggguuacgaacacauccgguugucgacacauaauguaauuaacgccgagaaugcaccagggggacccuauaaaaucggcacuucaggcagcugcccuaacguuaccaaugggaacggauucuuugccacaauggcuugggcagugccaaagaaugacaacaauaaaaccgccacgaacagucucacuauugaagucccguacaucuguacagagggugaggaucagauaaccguguggggcuuccacuccgacaacgaaacucagauggcuaagcuguauggggauucuaaaccccagaaguuuacaagcuccgccaauggagugaccacgcacuacgucucacaaauuggcgguuucccuaaccagaccgaggacgggggacugccacagaguggccgcaucguuguggauuauaugguacaaaagagcggcaaagcggggacaauuacuuaccagagaggaauccucuuaccccagaagguguggugcgcaucugguagguccaaagucaucaagggcucacugccucuuauuggggaagccgacuguuugcaugagaaauauggaggccugaauaagagcaaaccauacuacaccggugagcacgcuaaggccauagggaacugccccaucugggugaagacaccgcuaaaacucgcaaauggcacuaaguaucggccucccgcuaaacugcuuaaggaacgcggauuuuucggcgccauugcgggguuucuggagggagguugggaaggcaugaucgccggguggcauggauacaccagucacggcgcacacgguguugcuguggccgcugauuugaaaucuacacaggaggccauaaacaagauuaccaagaaucucaacucccugagcgaauuagaggucaaaaaucugcagcgacucucgggggcaauggacgagcuucauaacgaaauccuggaguuggaugaaaagguggacgaccuaagagccgauacuaucucuucccaaauugagcuggcuguacuccugucaaaugaaggcaucauuaacagugaggacgagcaccuucuggcguuggaaaggaaacucaagaaaaugcugggaccaagcgcaguugagauaggcaauggguguuucgaaacgaagcauaagugcaaccagacaugcuuagaucggaucgccgcuggaaccuuugacgccggugaguucucccugccuacuuuugauucucuaaauauuaccgcagccagccucaacgacgauggccuggacaaccacacaauccuuuuguauuacucaaccgcugccaguucccuggcagugacucucaugaucgcgauuuucgucguguauauggucagccgugauaaugugucuuguucaauaugccuguga

SEQ ID NO: 150195 - RNA, 1755 nt, Artificial Sequence; identical to SEQ ID NO: 148836
  derived and/or modified sequence opt3 from hemagglutinin__InfluenzaB__AHL94869

SEQ ID NO: 150196 - RNA, 1758 nt, Artificial Sequence; identical to SEQ ID NO: 149005
  derived and/or modified sequence opt3 from hemagglutinin__InfluenzaB__AHL94880

SEQ ID NO: 150197 - RNA, 1758 nt, Artificial Sequence; identical to SEQ ID NO: 149338
  derived and/or modified sequence opt3 from hemagglutinin__InfluenzaB__AHL94889

SEQ ID NO: 150198 - RNA, 1758 nt, Artificial Sequence; identical to SEQ ID NO: 149005
  derived and/or modified sequence opt3 from hemagglutinin__InfluenzaB__AHL94900

SEQ ID NO: 150199 - RNA, 1758 nt, Artificial Sequence
  derived and/or modified sequence opt3 from hemagglutinin__InfluenzaB__AHL94911
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcagaacagggacuauuaccuaccaaaggggaauccugcucccacagaaaguguggugcgcgagcggucggucuaaggucaucaaaggcuccuuaccccugauuggggaagcagacugucuucaugagaaguauggaggcuugaauaaaucaaagccguacuacacaggugagcacgccaaggcuauagggaacugcccuaucugggugaaaacuccccugaagcuagccaauggcaccaaauaucgcccuccagcaaagcuccugaaagaacgaggauuuuucggcgcuauugccggguuucuugagggagguugggaaggcaugaucgcgggguggcauggauacacaagccacggcgcccacgguguugcaguggcugccgaucugaagaguacccaggaggcuauaaacaagauuacuaaaaauuugaacucucucuccgaacuggaggucaagaauuuacagagacugagcggggccauggacgagcuccauaacgaaauccuugagcuggaugaaaaaguggacgacuugagggcagauacgaucucgucucaaauugagcuagccguacugcucuccaaugaaggcaucauuaacucagaggacgagcaucugcuugcucuggaacggaaguugaaaaagaugcucggacccagugcgguugagauaggcaauggguguuucgaaacaaagcacaaaugcaaccagaccugccuggaucguaucgcagccggaacuuuugacgcuggugaguucagcuuaccaaccuuugauucccugaauauuacagccgcaucucuaaacgacgauggccucgacaaucacaccauccugcuuuauuacagcacugccgcuucaaguuuggccgugacacugaugaucgcaauuuucgucguguauauggucucccgcgauaacgugagcuguucuauaugccucuga

SEQ ID NO: 150200 - RNA, 1758 nt, Artificial Sequence; identical to SEQ ID NO: 149005
  derived and/or modified sequence opt3 from hemagglutinin__InfluenzaB__AHL94922

SEQ ID NO: 150201 - RNA, 1758 nt, Artificial Sequence
  derived and/or modified sequence opt3 from hemagglutinin__InfluenzaB__AHL94933
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauauuaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaagcggggacaaucacuuaccaaagaggaauccucuuaccucagaagguauggugcgcaagcgguaggucuaaagugauuaagggcucccugccacuuauaggggaagccgacuguuugcaugagaaauauggaggccugaauaagucaaagcccuacuacaccggugagcacgcuaaagccaucgggaacugcccgauuugggucaagacaccucuaaaacucgcaaauggcacuaaguaucggcccccagcuaaacugcuuaaggaacgcggauuuuucggcgccaucgcgggguuucuggagggagguugggaaggcaugauagccggguggcauggauacaccagccacggcgcacacgguguggcuguugccgcugauuugaagaguacacaggaggccauuaacaaaaucaccaagaaucucaacucucuguccgaauuagaggugaaaaaucugcagcgacucagcggggcaauggacgagcuucauaacgaaauccuggaguuggaugaaaaggucgacgaccuaagagccgauacuauuucgucucaaaucgagcuggcugugcuccuguccaaugaaggcauuauaaacucagaggacgagcaccuucuggcguuggaaaggaaacucaagaagaugcugggaccuagugcaguagagaucggcaauggguguuucgaaacgaaacauaagugcaaccagacaugcuuagaucggauugccgcuggaaccuuugacgccggugaguucagccugcccacuuuugauucccuaaauaucaccgcagccucucucaacgacgauggccuggacaaucacacaauccuuuuguauuacagcaccgcugccucaagucuggcaguuacucucaugauugcgauauucguggucuauauggugucccgugauaacgucagcuguucuaucugccuguga

SEQ ID NO: 150202 - RNA, 1758 nt, Artificial Sequence; identical to SEQ ID NO: 150086
  derived and/or modified sequence opt3 from hemagglutinin__InfluenzaB__AHL94944

SEQ ID NO: 150203 - RNA, 1758 nt, Artificial Sequence; identical to SEQ ID NO: 148699
  derived and/or modified sequence opt3 from hemagglutinin__InfluenzaB__AHL94955

SEQ ID NO: 150204 - RNA, 1758 nt, Artificial Sequence; identical to SEQ ID NO: 148699
  derived and/or modified sequence opt3 from hemagglutinin__InfluenzaB__AHL94965

SEQ ID NO: 150205 - RNA, 1758 nt, Artificial Sequence; identical to SEQ ID NO: 148699
  derived and/or modified sequence opt3 from hemagglutinin__InfluenzaB__AHL94975

SEQ ID NO: 150206 - RNA, 1755 nt, Artificial Sequence; identical to SEQ ID NO: 148870
  derived and/or modified sequence opt3 from hemagglutinin__InfluenzaB__AHM00986

SEQ ID NO: 150207 - RNA, 1758 nt, Artificial Sequence; identical to SEQ ID NO: 148903
  derived and/or modified sequence opt3 from hemagglutinin__InfluenzaB__AHM00997

SEQ ID NO: 150208 - RNA, 1758 nt, Artificial Sequence
  derived and/or modified sequence opt3 from hemagglutinin__InfluenzaB__AHM01008
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuuggaccgugccgaaaaaugauaagaacaaaacggcaacuaauccacucacaauugaaguccccuacaucuguaccgagggugaggaccagauaacuguguggggcuuccacagugauaacgaaacacagauggccaagcuguauggggacuccaagccucagaaauuuaccucuagcgcuaauggagugacgacccacuacgucucccaaauuggcgguuucccaaaccagacagaggaugggggacugccccagucaggccgcaucguuguggacuauaugguacagaagaguggcaaaacugggaccauuacauaccaaagaggaauccucuuaccucagaagguguggugcgccagcgguaggucuaaagucaucaagggcucccugccacuuauuggggaagcggauuguuugcaugagaaauauggaggccugaacaagucaaagcccuacuacacuggugagcacgcaaaagccauagggaauugcccgaucugggugaagaccccucuaaaacucgcuaacggcacaaaguaucggcccccagccaaacugcuuaaggaacgcggauuuuucggcgcaauugcuggguuucuggagggagguugggaaggcaugaucgccggguggcauggauacaccagccacggcgcgcacgguguugccguggcagcugacuugaagaguacucaggaggccauaaauaaaauuacgaagaaccucaauucucuguccgaauuagaggucaaaaaccugcagcgacucagcggggcuauggaugagcuucauaaugaaauccuggaguuggacgaaaagguggacgaucuaagagccgacacaaucucgucucaaauugagcuggcaguacuccuguccaacgaaggcaucauuaauucagaggaugagcaccuucuggccuuggaaaggaaacucaagaagaugcugggaccuagugcuguugagauaggcaacggguguuucgaaaccaaacauaagugcaaucagacuugcuuagaccggaucgcggcaggaaccuuugaugccggugaguucagccugcccacauuugacucccuaaacauuaccgcugccucucucaaugaugacggccuggauaaccacacuauccuuuuguauuacagcacagcagccucaagucuggcugugacgcucaugaucgccauuuucgucguguauauggucucccgugacaaugugagcuguucuauaugccuguga

SEQ ID NO: 150209 - RNA, 1758 nt, Artificial Sequence; identical to SEQ ID NO: 148903
  derived and/or modified sequence opt3 from hemagglutinin__InfluenzaB__AHM01019

SEQ ID NO: 150210 - RNA, 1758 nt, Artificial Sequence; identical to SEQ ID NO: 148903
  derived and/or modified sequence opt3 from hemagglutinin__InfluenzaB__AHM01030

SEQ ID NO: 150211 - RNA, 1758 nt, Artificial Sequence
  derived and/or modified sequence opt3 from hemagglutinin__InfluenzaB__AHM01041
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagagugagaaaacaggcacuauuaccuaccaaagagggauccucuuaccucagaagguguggugcgcgagcggaaggucuaaagucaucaaggguucccugccacuuauuggcgaagcagauuguuugcaugagaaauaugggggacugaacaagucaaagcccuacuacacaggcgaacacgccaaagcuauagguaauugcccgaucugggugaagacuccucuaaaacucgccaacgggaccaaguaucggcccccagcaaaacugcuuaaggagcgcggcuuuuucggagcuauugccggcuuucuggaagggggaugggaggguaugaucgcgggcuggcauggguacacaagccacggagcccacggcguugcaguggcugccgacuugaagaguacccaggaagcuauaaauaaaauuacuaagaaccucaauucucuguccgaguuagaggucaaaaaccugcagcgacucagcggugccauggaugaacuucauaaugagauccuggaauuggacgagaagguggacgaucuaagagcagacacgaucucgucucaaauugaacuggccguacuccuguccaacgaggggaucauuaauucagaggaugaacaccuucuggcuuuggagaggaaacucaagaagaugcugggcccuagugcgguugaaauaggaaacggcuguuucgagacaaaacauaagugcaaucagaccugcuuagaccggaucgcagccgggacuuuugaugcuggagaguucagccugcccaccuuugacucccuaaacauuacagccgcaucucucaaugaugacggucuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 150212 - RNA, 1758 nt, Artificial Sequence
  derived and/or modified sequence opt3 from hemagglutinin__InfluenzaB__AHM01052
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccaucaugcuuuauuacagcacugccgcuucaaguuuggccgugacacugaugaucgcaauuuucgucguguauauggucucccgugauaacgugagcuguucuauaugccucuga

SEQ ID NO: 150213 - RNA, 1758 nt, Artificial Sequence; identical to SEQ ID NO: 148903
  derived and/or modified sequence opt3 from hemagglutinin__InfluenzaB__AHM01063

SEQ ID NO: 150214 - RNA, 1755 nt, Artificial Sequence; identical to SEQ ID NO: 148870
  derived and/or modified sequence opt3 from hemagglutinin__InfluenzaB__AHM01074

SEQ ID NO: 150215 - RNA, 1755 nt, Artificial Sequence
  derived and/or modified sequence opt3 from hemagglutinin__InfluenzaB__AHM01096
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggauuuuacugccucagaaaguguggugcgcuucuggaagguccaaggucaucaaagguucacuuccauugauuggcgaagccgauugucugcaugagaaguacgggggacuaaacaaaagcaagcccuacuauacuggcgaacacgcaaaggcuaucgguaauugcccgaucugggugaaaaccccucucaagcuggccaacgggacaaaauaccggcccccagcgaagcugcugaaagagcgcggcuuuuucggagccauugcaggcuuuuuggaagggggaugggaagguaugauagcuggcuggcacggguauacaagucauggagcccacggcguugcuguggccgcagaccucaagucuacccaggaggccaucaauaagauuacuaaaaaccuuaauuccuuaagcgaacuggaggucaagaaccuccaacgacuuucgggugcuauggacgaacugcauaaugagaucuuggagcuagaugaaaaaguggacgaucugagagcggacaccauaucuucccagauugagcucgcaguacugcuuucaaacgaagggaucaucaauagugaggaugaacaccuguuggcccucgagaggaagcugaaaaagauguuaggcccuagcgcuguugacauuggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccauauugcuguacuauucaacagcagcgaguucccucgcugugacccugaugcuugccaucuucauugucuacauggugagccgugacaacgucucuuguucaaucugccuguga

SEQ ID NO: 150216 - RNA, 1758 nt, Artificial Sequence; identical to SEQ ID NO: 148903
  derived and/or modified sequence opt3 from hemagglutinin__InfluenzaB__AHM01107

SEQ ID NO: 150217 - RNA, 1758 nt, Artificial Sequence
  derived and/or modified sequence opt3 from hemagglutinin__InfluenzaB__AHM01118
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaauaaaauuacuaagaaccucaauucucuguccgaauuagaggucaaaaaccugcagcgacucagcggggccauggaugagcuucauaaugaaauccuggaguuggacgaaaagguggacgaucuaagagcagacacgaucucgucucaaauugagcuggccguacuccuguccaacgaaggcaucauuaauucagaggaugagcaccuucuggcuuuggaaaggaaacucaagaagaugcugggaccuagugcgguugagauaggcaacggguguuucgaaacaaaacauaagugcaaucagaccugcuuagaccggaucgcagccggaacuuuugaugcuggugaguucagccugcccaccuuugacucccuaaacauuacagccgugucucucaaugaugacggccuggauaaccacaccauccuuuuguauuacagcacugcagccucaagucuggcugucacacucaugaucgccauuuucguggucuauauggugucccgugacaauguuagcuguucuauaugccuguga

SEQ ID NO: 150218 - RNA, 1758 nt, Artificial Sequence; identical to SEQ ID NO: 148903
  derived and/or modified sequence opt3 from hemagglutinin__InfluenzaB__AHM01129

SEQ ID NO: 150219 - RNA, 1758 nt, Artificial Sequence
  derived and/or modified sequence opt3 from hemagglutinin__InfluenzaB__AHM01140
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucggcccauaacguaauuaaugcagagaacgccccagggggacccuauaagaucggcacaucaggcagcugcccuaauguuacuaacgggaauggauucuuugcuaccauggcaugggccgugccgaaaaacgacaagaauaaaacagcuaccaacccacucacgauugaaguccccuacaucuguacugagggugaggaucagauaacaguguggggcuuccacagugacaaugaaacccagauggccaagcuguauggggauuccaagccucagaaauuuacuucuagcgcgaacggagugacaacccacuacgucucccaaauuggcgguuucccaaaccagacggaggacgggggacugccccagucaggccgcaucguuguggauuauaugguacagaagaguggcaaaaccgggacaauuacuuaccaaagaggaauccucuuaccucagaagguguggugcgcaagcgguaggucuaaagucaucaagggcucccugccacuuauuggggaagccgacuguuugcaugagaaauauggaggccugaauaagucaaagcccuacuacaccggugagcacgcuaaagccauagggaacugcccgaucugggugaagacaccucuaaaacucgcaaauggcacuaaguaucggcccccagcuaaacugcuuaaggaacgcggauuuuucggcgccauugcgggguuucuggagggagguugggaaggcaugaucgccggguggcauggauacaccagccacggcgcacacgguguugcuguggccgcugauuugaagaguacacaggaggccauaaacaaaauuaccaagaaucucaacucucuguccgaauuagaggucaaaaaucugcagcgacucagcggggcaauggacgagcuucauaacgaaauccuggaguuggaugaaaagguggacgaccuaagagccgauacuaucucgucucaaauugagcuggcuguacuccuguccaaugaaggcaucauuaacucagaggacgagcaccuucuggcguuggaaaggaaacucaagaagaugcugggaccuagugcaguugagauaggcaauggguguuucgaaacgaaacauaagugcaaccagacaugcuuagaucggaucgccgcuggaaccuuugacgccggugaguucagccugcccacuuuugauucccuaaauauuaccgcagccucucucaacgacgauggccuggacaaucacacaauccuuuuguauuacagcaccgcugccucaagucuggcagugacucucaugaucgcgauuuucgucguguauauggucucccgugauaacgugagcuguucuauaugccuguga

SEQ ID NO: 150220 - RNA, 1758 nt, Artificial Sequence; identical to SEQ ID NO: 148888
  derived and/or modified sequence opt3 from hemagglutinin__InfluenzaB__AHM01151

SEQ ID NO: 150221 - RNA, 1758 nt, Artificial Sequence
  derived and/or modified sequence opt3 from hemagglutinin__InfluenzaB__AHM01162
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccaaggacgcaccagggggacccuauaaaaucggcacuucaggcagcugcccuaacguuaccaaugggaacggauucuuugccacaauggcuugggcagugccaaagaaugauaaaaacaagaccgccacgaauccgcucacuauugagguccccuacaucuguacagaaggugaggaccagauaaccguguggggcuuccacagugauaacgagacucagauggcuaagcuguauggggacuccaaaccucagaaguuuacaucuagcgccaauggagugaccacgcacuacgucucccaaauuggcgguuucccaaaccagaccgaagaugggggacugccccagucaggccgcaucguuguggacuauaugguacagaaaaguggcaagacagggacuauuaccuaccaaagaggaauccucuuaccucagaaaguguggugcgcgagcgguaggucuaaggucaucaaaggcucccugccacuuauuggggaggcagauuguuugcaugaaaaguauggaggccugaacaagucaaaacccuacuacacaggugagcacgccaaggcuauagggaauugcccgaucugggugaaaacuccucuaaagcucgccaacggcaccaaauaucggcccccagcaaagcugcuuaaggagcgcggauuuuucggcgcuauugccggguuucuggaaggagguugggagggcaugaucgcgggguggcauggauacacaagccacggcgcccacgguguugcaguggcugccgacuugaaaaguacccaggaagcuauaaauaagauuacuaaaaaccucaauucucuguccgaguuagaagucaagaaccugcagcgacucagcggggccauggaugagcuucauaaugagauccuggaauuggacgagaaaguggacgaucuaagagcagacacgaucucgucucaaauugaacuggccguacuccuguccaacgagggcaucauuaauucagaagaugagcaccuucuggcuuuggagaggaagcucaagaaaaugcugggaccuagugcgguugaaauaggcaacggguguuucgagacaaagcauaaaugcaaucagaccugcuuagaccggaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 150222 - RNA, 1755 nt, Artificial Sequence; identical to SEQ ID NO: 148870
  derived and/or modified sequence opt3 from hemagglutinin__InfluenzaB__AHM01173

SEQ ID NO: 150223 - RNA, 1758 nt, Artificial Sequence
  derived and/or modified sequence opt3 from hemagglutinin__InfluenzaB__AHM01184
augaaggccaucauugugcugcucauggucguuaccagcaacgcugacagaauaugcacaggcaucacuuccucuaauucaccccacgugguaaaaacggcaacccagggggaggugaacgucacaggagugauuacucuuaccacaaccccuacuaagagucauuucgccaaucugaaagguacagaaaccaggggcaaguuguguccaaaaugcuuaaacuguacggaucuggacguugcgcuagggcggccgaagugcacuggaaagauccccagcgcucgcguguccauucuccacgagguccgaccugugaccucuggcuguuuuccaaucaugcaugaucguacaaaaauaagacaacugcccaaucuucugagggguuacgaacacauccgguugucgacucauaacguaauuaaugccgaggacgcaccugggggaccauauaagaucggcaccucaggcagcugccccaacguuacaaaugggaacggauucuuugccaccauggcuugggcagugccuaaaaaugauaagaacaaaacggccacuaauccacucacaauugaagucccguacaucuguaccgagggugaggaccagauaacuguguggggcuuccacagugauaacgaaacacagauggcuaagcuguauggggacuccaagccccagaaauuuaccucuagcgccaauggagugacgacccacuacgucucccaaauuggcgguuucccuaaccagacagaggaugggggacugccacagucaggccgcaucguuguggacuauaugguacagaagaguggcaaaacugggaccauuacauaccaaagaggaauccucuuaccccagaagguguggugcgcgagcgguaggucuaaagucaucaagggcucccugccucuuauuggggaagcagauuguuugcaugagaaauauggaggccugaacaagucaaagccauacuacacuggugagcacgccaaagcuauagggaauugccccaucugggugaagaccccgcuaaaacucgccaacggcacaaaguaucggccucccgcaaaacugcuuaaggaacgcggauuuuucggcgcuauugccggguuucuggagggagguugggaaggcaugaucgcgggguggcauggauacaccagccacggcgcccacgguguugcaguggcugccgacuugaagaguacucaggaggcuauaaauaaaauuacgaagaaccucaauucucuguccgaauuagaggucaaaaaccugcagcgacucagcggggccauggaugagcuucauaaugaaauccuggaguuggacgaaaagguggacgaucuaagagcagacacaaucucgucucaaauugagcuggccguacuccuguccaacgaaggcaucauuaauucagaggaugagcaccuucuggcuuuggaaaggaaacucaagaagaugcugggaccaagugcgguugagauaggcaacggguguuucgaaaccaaacauaagugcaaucagacuugcuuagaccggaucgcagccggaaccuuugaugcuggugaguucagccugccuacauuugacucccuaaacauuaccgccgcaucucucaaugaugacggccuggauaaccacacuauccuuuuguauuacagcacagccgcuucaagucuggccgugacgcucaugaucgcaauuuucgucguguauauggucucccgugacaaugugagcuguucuauaugccuguga

SEQ ID NO: 150224 - RNA, 1758 nt, Artificial Sequence; identical to SEQ ID NO: 150219
  derived and/or modified sequence opt3 from hemagglutinin__InfluenzaB__AHM01195

SEQ ID NO: 150225 - RNA, 1758 nt, Artificial Sequence
  derived and/or modified sequence opt3 from hemagglutinin__InfluenzaB__AHM01206
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagagugagaaaacaggcacuauuaccuaccaaagagggauccucuuaccucagaagguguggugcgcgagcggaaggucuaaagucaucaaggguucccugccacuuauuggcgaagcagauuguuugcaugagaaauaugggggacugaacaagucaaagcccuacuacacaggcgaacacgccaaagcuauagguaauugcccgaucugggugaagacuccucuaaaacucgccaacgggaccaaguaucggcccccagcaaaacugcuuaaggagcgcggcuuuuucggagcuauugccggcuuucuggaagggggaugggaggguaugaucgcgggcuggcauggguacacaagccacggagcccacggcguugcaguggcugccgacuugaagaguacccaggaagcuauaaauaaaauuacuaagaaccucaauucucuguccgaguuagaggucaaaaaccugcagcgacucagcggugccauggaugaacuucauaaugagauccuggaauuggacgagaagguggacgaucuaagagcagacacgaucucgucucaaauugaacuggccguacuccuguccaacgaggggaucauuaauucagaggaugaacaccuucuggcuuuggagaggaaacucaagaagaugcugggcccuagugcgguugaaauaggaaacggcuguuucgagacaaaacauaagugcaaucagaccugcuuagaccggaucgcagccgggacuuuugaugcuggagaguucagccugcccaccuuugacucccuaaacauuacagccgcaucucucaaugaugacggucugggcaaccacaccauccuuuuguauuacagcacugccgcuucaagucuggccgugacacucaugaucgcaauuuucgucguguauauggucucccgugauaaugugagcuguucuauaugccuguga

SEQ ID NO: 150226 - RNA, 1758 nt, Artificial Sequence; identical to SEQ ID NO: 148888
  derived and/or modified sequence opt3 from hemagglutinin__InfluenzaB__AHM01217

SEQ ID NO: 150227 - RNA, 1755 nt, Artificial Sequence; identical to SEQ ID NO: 148870
  derived and/or modified sequence opt3 from hemagglutinin__InfluenzaB__AHM01228

SEQ ID NO: 150228 - RNA, 1758 nt, Artificial Sequence; identical to SEQ ID NO: 148903
  derived and/or modified sequence opt3 from hemagglutinin__InfluenzaB__AHM01239

SEQ ID NO: 150229 - RNA, 1758 nt, Artificial Sequence; identical to SEQ ID NO: 148903
  derived and/or modified sequence opt3 from hemagglutinin__InfluenzaB__AHM01250

SEQ ID NO: 150230 - RNA, 1758 nt, Artificial Sequence
  derived and/or modified sequence opt3 from hemagglutinin__InfluenzaB__AHM01261
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccaaagaacgacaagaauaaaaccgccacgaacccgcucacuauugaaguccccuacaucuguacagagggugaggaucagauaaccauuuggggcuuccacagugacaaugaaacucagauggcuaagcuguauggggauuccaacccucagaaguuuacaucuagcgccaacggagugaccacgcacuacgugucccaaaucggcgguuucccaaaucagaccgaggacgggggacugccccagucaggccgcauugucguugauuauauggugcagaaaaguggcaagacagggacuaucaccuaccaaagaggaauccucuuaccucagaaaguauggugcgcggguggcaggagcaaggugauuaaagggucucugccacuuauaggagaagcagacuguuugcaugagaaguauggcggucugaacaaauccaagcccuacuacacaggggagcacgccaaggcuaucggcaauugcccgauuugggucaaaacuccucuaaagcucgccaacggaaccaaauaucggcccccagcaaagcugcuuaaagaacgcggcuuuuucggggcuaucgccggauuucuggaggguggcugggaagggaugauagcgggauggcauggcuacacaucacacggugcccacgggguggcaguugcugccgauuugaaaagcacccaggaggcuauuaauaagaucacuaaaaaccucaauagucugucugaauuagaggugaagaaccugcagcgacucuccggcgccauggacgagcuucauaaugaaauccuggaguuggaugaaaaagucgacgaccuaagagcagauacgauuagcucgcaaaucgagcuggccgugcuccugucuaacgaaggaauuauaaauuccgaggacgagcaccuucuggcuuuggaaaggaagcucaaaaagaugcugggcccuucagcgguagagaucgggaacggauguuucgaaacaaagcauaaaugcaaucagaccugcuuagaucggauugcagccgguacuuuugacgcuggcgaguucagucugcccaccuuugauagccuaaacaucacagccgcaucccucaaugacgaugggcuggacaaccacaccauccuuuuguauuacucuacugccgcuagcucacuggccguuacacucaugauugcaauauucguggucuauauggugagucgugauaacgucuccuguagcaucugccuguga

SEQ ID NO: 150231 - RNA, 1755 nt, Artificial Sequence; identical to SEQ ID NO: 148870
  derived and/or modified sequence opt3 from hemagglutinin__InfluenzaB__AHM01272

SEQ ID NO: 150232 - RNA, 1758 nt, Artificial Sequence; identical to SEQ ID NO: 150219
  derived and/or modified sequence opt3 from hemagglutinin__InfluenzaB__AHM01283

SEQ ID NO: 150233 - RNA, 1758 nt, Artificial Sequence; identical to SEQ ID NO: 150219
  derived and/or modified sequence opt3 from hemagglutinin__InfluenzaB__AHM01294

SEQ ID NO: 150234 - RNA, 1755 nt, Artificial Sequence; identical to SEQ ID NO: 148870
  derived and/or modified sequence opt3 from hemagglutinin__InfluenzaB__AHM01305

SEQ ID NO: 150235 - RNA, 1758 nt, Artificial Sequence; identical to SEQ ID NO: 148903
  derived and/or modified sequence opt3 from hemagglutinin__InfluenzaB__AHM01316

SEQ ID NO: 150236 - RNA, 1758 nt, Artificial Sequence; identical to SEQ ID NO: 150219
  derived and/or modified sequence opt3 from hemagglutinin__InfluenzaB__AHM01327

SEQ ID NO: 150237 - RNA, 1758 nt, Artificial Sequence; identical to SEQ ID NO: 148903
  derived and/or modified sequence opt3 from hemagglutinin__InfluenzaB__AHM01338

SEQ ID NO: 150238 - RNA, 1758 nt, Artificial Sequence; identical to SEQ ID NO: 148903
  derived and/or modified sequence opt3 from hemagglutinin__InfluenzaB__AHM01349

SEQ ID NO: 150239 - RNA, 1758 nt, Artificial Sequence
  derived and/or modified sequence opt3 from hemagglutinin__InfluenzaB__AHM01360
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacaaagggugaggaucagauaaccguguggggcuuccacagugacaaugagacucagauggcuaagcuguauggggauuccaacccucagaaauuuacaucuagcgccaacggagugaccacgcacuacgucucccaaauuggcgguuucccaaaucagaccgaagacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaggcagacuguuugcaugaaaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggagcgcggauuuuucggcgcuauugccggguuucuggaaggagguugggagggcaugaucgcgggguggcauggauacacaagccacggcgcccacgguguugcaguggcugccgauuugaagaguacccaggaagcuauaaauaaaauuacuaagaaccucaauucucuguccgaguuagaagucaaaaaccugcagcgacucagcggggccauggacgagcuucauaaugagauccuggaauuggaugagaagguggacgaccuaagagcagauacgaucucgucucaaauugaacuggccguacuccuguccaacgagggcaucauuaauucagaagacgagcaccuucuggcuuuggagaggaaacucaagaagaugcugggaccuagugcgguugaaauaggcaacggguguuucgagacaaaacauaagugcaaucagaccugcuuagaucggaucgcagccggaacuuuugacgcuggugaguucagccugcccaccuuugauucccuaaacauuacagccgcaucucucaaugacgauggccuggacaaccacaccauccuuuuguauuacagcacugccgcuucaagucuggccgugacacucaugaucgcaauuuucgucguguauauggucucccgugauaacgugagcuguucuauaugccuguga

SEQ ID NO: 150240 - RNA, 1755 nt, Artificial Sequence
  derived and/or modified sequence opt3 from hemagglutinin__InfluenzaB__AHM01371
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaagaauggguucuuugccaccauggcuugggccguuccuaaagacaacaauaagaacgcgacgaauccacugacuguggaggucccguauauuugugcagaaggagaggaucagaucgccgugugggguuuccauuccgacaacaaaacacagaugaagaaucuguacggcgauucuaacccccaaaaguuuaccagcuccgcuaacggggugacuacacacuaugucucacagauuggaggcuucccugaccagaccgaggauggugggcucccacagaguggacgcaucguuguggacuacaugaugcaaaaacccggcaagacgggcaccauaguauaucagagagggguguuacugccucagaaagucuggugcgccagcggaaggucuaaggugauuaaagguucccuuccauugaucggcgaagcagauugucugcaugagaaguacgggggacuaaauaaaucaaagcccuacuauacaggcgaacacgcuaaggccauugguaacugcccgaucuggguuaaaacuccucucaagcuggcgaaugggaccaaauaccggcccccagccaaacuucugaaggagcgcggcuuuuucggagcaaucgcuggcuuuuuggaagggggaugggaagguaugauugccggcuggcacggguauacaagccauggagcucacggcguggccgucgcagccgaccucaagaguacucaggaggcuauaaacaagaucaccaaaaaucugaacucuuuauccgaacuggaggugaagaaucuccaacgacuuagcggugcgauggacgaacugcauaacgagauuuuggagcuagaugaaaaaguagacgaucugagagcagacacaaucucgucucagauagagcucgccguucugcuuuccaaugaagggauuaucaacucagaggaugaacaccuguuggcucucgagaggaagcugaaaaagauguuaggcccuagugccguggacaucggaaauggcuguuucgagaccaagcacaaaugcaaccagacuugccuggaucggauugcagccgggacguuuaaugcuggagaguucagccuacccacauuugacucccucaacaucaccgccgcaucucugaaugaugacggucuugauaaccauacuauuuugcuguacuauagcaccgcggcuucaagucucgccgucacacugaugcuugcaauauucaucguguacauggucucccgugacaacgugagcuguucuauuugccuguga

SEQ ID NO: 150241 - RNA, 1755 nt, Artificial Sequence; identical to SEQ ID NO: 148870
  derived and/or modified sequence opt3 from hemagglutinin__InfluenzaB__AHM01382

SEQ ID NO: 150242 - RNA, 1758 nt, Artificial Sequence
  derived and/or modified sequence opt3 from hemagglutinin__InfluenzaB__AHM01393
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauguaaccaacgggaauggauucuuugccacaauggcuugggcaguuccgaaaaacgacaagaauaaaaccgccacgaacccacucacuaucgaagugcccuacauauguacagagggugaggaucagauuaccgucuggggcuuccacagugacaaugaaacucagauggcuaagcuguauggggauuccaagccucagaaauuuacaucuagcgccaacggagugaccacgcacuacgugucccaaaucggcgguuucccaaaccagaccgaggacgggggacugccccagucaggccgcauugucguugauuauauggugcagaagaguggcaaaacagggacuaucaccuaccaaagaggaauccucuuaccucagaagguauggugcgcgagcgguaggucuaaagugauuaagggcucccugccacuuauaggggaagcagacuguuugcaugagaaauauggaggccugaauaagucaaagcccuacuacacaggugagcacgccaaagcuaucgggaacugcccgauuugggucaagacuccucuaaaacucgccaauggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaacaaaaucacuaagaaucucaacucucuguccgaauuagaggugaaaaaucugcagcgacucagcggggccauggacgagcuucauaacgaaauccuggaguuggaugaaaaggucgacgaccuaagagcagauacgauuucgucucaaaucgagcuggccgugcuccuguccaaugaaggcauuauaaacucagaggacgagcaccuucuggcuuuggaaaggaaacucaagaagaugcugggaccuagugcgguagagaucggcaauggguguuucgaaacaaaacauaagugcaaccagaccugcuuagaucggauugcagccggaacuuuugacgcuggugaguucagccugcccaccuuugauucccuaaauaucacagccgcaucucucaacgacgauggccuggacaaucacaccauccuuuuguauuacagcacugccgcuucaagucuggccguuacacucaugauugcaauauucguggucuauauggugucccgugauaacgucagcuguucuaucugccuguga

SEQ ID NO: 150243 - RNA, 1758 nt, Artificial Sequence; identical to SEQ ID NO: 148903
  derived and/or modified sequence opt3 from hemagglutinin__InfluenzaB__AHM01404

SEQ ID NO: 150244 - RNA, 1758 nt, Artificial Sequence
  derived and/or modified sequence opt3 from hemagglutinin__InfluenzaB__AHM01415
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuauugacuauauggugcagaagaguggcaaaacagggacuaucaccuaccaaagaggaauccucuuaccucagaagguauggugcgcgagcgguaggucuaaagugauuaagggcucccugccacuuauaggggaagcagauuguuugcaugagaaauauggaggccugaacaagucaaagcccuacuacacaggugagcacgccaaagcuaucgggaauugcccgauuugggucaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgacuugaagaguacccaggaggcuauuaauaaaaucacuaagaaccucaauucucuguccgaauuagaggugaaaaaccugcagcgacucagcggggccauggaugagcuucauaaugaaauccuggaguuggacgaaaaggucgacgaucuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaaugucagcuguucuaucugccuguga

SEQ ID NO: 150245 - RNA, 1758 nt, Artificial Sequence
  derived and/or modified sequence opt3 from hemagglutinin__InfluenzaB__AHM01426
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccauuuggggcuuccacagugacaaugaaacucagauggcuaagcuguauggggauuccaacccucagaaguuuacaucuagcgccaacggagugaccacgcacuacgugucccaaaucggcgguuucccaaaucagaccgaggacgggggacugccccagucaggccgcauugucguugauuauauggugcagaaaaguggcaagacagggacuaucaccuaccaaagaggaauccucuuaccucagaaaguauggugcgcgagcgguaggucuaaggugauuaaaggcucccugccacuuauaggggaagcagacuguuugcaugagaaguauggaggccugaacaaaucaaagcccuacuacacaggugagcacgccaaggcuaucgggaauugcccgauuugggucaaaacuccucuaaagcucgccaacggcaccaaauaucggcccccagcaaagcugcuuaaagaacgcggauuuuucggcgcuaucgccggguuucuggagggagguugggaaggcaugauagcgggguggcauggauacacaagccacggcgcccacgguguggcaguugcugccgauuugaagaguacccaggaggcuauuaauaagaucacuaaaaaccucaauucucuguccgaauuagaggugaagaaccugcagcgacucagcggggccauggacgagcuucauaaugaaauccuggaguuggaugaaaaagucgacgaccuaagagcagauacgauuucgucucaaaucgagcuggccgugcuccuguccaacgaaggcauuauaaauucagaggacgagcaccuucuggcuuuggaaaggaagcucaaaaagaugcugggaccuagugcgguagagaucggcaacggguguuucgaaacaaagcauaaaugcaaucagaccugcuuagaucggauugcagccggaacuuuugacgcuggugaguucagccugcccaccuuugauucccuaaacaucacagccgcaucucucaaugacgauggccuggacaaccacaccauccuuuuguauuacagcacugccgcuucaagucuggccguuacacucaugauugcaauauucguggucuauauggugucccgugauaacgucagcuguucuaucugccuguga

SEQ ID NO: 150246 - RNA, 1755 nt, Artificial Sequence
  derived and/or modified sequence opt3 from hemagglutinin__InfluenzaB__AHM01437
augaaggccgugaucguccugcucaugguugugaccagcaacgcugacagaauuugcacaggcauaacuuccucuaauucaccccacguagugaaaacggcaacccagggggaggucaacgugacaggaguuaucccucuuacuaccacaccaaccaagaguuacuucgccaaucugaaagguacuaagacaaggggcaaauuguguccggauugcuuaaacuguaccgaccuggauguggcgcuagggcggcccaugugcgucggaacgacuccuagcgcuaaggccuccauucuccaugaagugcgcccaguaaccucuggcuguuuucccaucaugcacgaccgaacaaagauucgucaacuggcaaaucuucugagagguuaugagaacaucagguugucgacucagaauguuauagaugccgaaaaagcuccugggggaccauaccggcucggcaccucaggcagcugccccaacgcaacaaguaaguccggguucuuugccaccauggcuugggccgugccuaaagacaauaacaagaaugcgacgaacccacugacugucgaggugccguauaucugugcagaagaggaggaucagauuacaguguggggauuccauucugacaauaaaacccagaugaagaaccuguacggugauagcaauccccaaaaguuuacuuccucagccaacggcgucacaacccacuauguuagucagaucgggggauucccugaccagacggaagauggcggucucccacagagcgggcgcauugugguagacuacaugaugcaaaaacccggaaagaccggcacaaucguguaucagagaggcgucuuacugccucagaaaguguggugcgcuucugggagguccaagguuauaaaaggaucacuuccauugauuggugaggccgauugucugcaugaaaaguacggcgggcuaaacaaaagcaagcccuacuauacuggagagcacgcaaaggcuaucggcaauugcccgauuugggugaaaaccccucucaagcuggccaacgguacaaaauaccggcccccagcgaagcugcugaaagagcgcggguuuuucggcgccaucgcaggauuuuuggaaggcgggugggagggaaugaucgcugguuggcacggcuauacaagucauggggcccacggagucgcuguggccgcagaccucaagucuacccaggaagccauuaauaagauaacuaaaaaccuuaauuccuuaagcgagcuggaaguaaagaaccuccaacgacuuucgggcgcuauggacgagcugcauaaugagaucuuggaacuagaugagaaaguugacgaucugagagcggacaccauuucuucccagaucgaacucgcagugcugcuuucaaacgaggguauaauuaauagugaagaugagcaccuguuggcccucgagaggaagcugaaaaagauguuagggccuagcgcugucgacaucggcaacggauguuucgaaacuaagcacaaaugcaaucagacgugccuggaucggaucgccgcaggcacauuuaacgccggggaguucucccuacccaccuuugacucucucaauauuacugcugccagccugaacgaugacggacuugauaaucauaccaucuugcuguacuauucaacagcagcgaguucccucgcugugacccugaugcuugccauuuucauagucuacauggugagccgugacaacguuucuuguucaaucugccuguga

SEQ ID NO: 150247 - RNA, 1755 nt, Artificial Sequence
  derived and/or modified sequence opt3 from hemagglutinin__InfluenzaB__AHM01448
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacugcagaggugccguauauuugugccgaaggagaggaucagaucacagucugggguuuccauucugacaauaaaacccagaugaagaaccuguacggcgauagcaauccccaaaaguuuacuuccucagcuaacggggugacaacccacuaugugagucagauuggaggcuucccugaccagacggaggauggugggcucccacagagcggacgcaucgucguugacuacaugaugcaaaaacccggcaagaccggcacaauaguguaucagagagggguauuacugccucagaaaguguggugcgccucuggaagguccaaggucauuaaagguucacuuccauugaucggcgaagcagauugucugcaugagaaguacgggggacuaaacaaaagcaagcccuacuauacuggcgaacacgcuaaggccauugguaauugcccgaucugggugaaaaccccucucaagcuggcgaacgggacaaaauaccggcccccagccaagcugcugaaagagcgcggcuuuuucggagcaaucgcuggcuuuuuggaagggggaugggaagguaugauugccggcuggcacggguauacaagucauggagcucacggcguugccguggcagccgaccucaagucuacccaggaggcuauaaauaagaucacuaaaaaccuuaauuccuuaagcgaacuggaggucaagaaccuccaacgacuuucgggugcgauggacgaacugcauaaugagauuuuggagcuagaugaaaaaguggacgaucugagagcagacaccaucucuucccagauagagcucgccguacugcuuucaaacgaagggauuaucaauagugaggaugaacaccuguuggcucucgagaggaagcugaaaaagauguuaggcccuagcgccguugacaucggaaacggcuguuucgagacuaagcacaaaugcaaucagacgugccuggaucggauugcagccgggacauuuaacgcuggagaguucucccuacccaccuuugacucucucaauaucacugccgcaagccugaacgaugacggucuugauaaucauaccauuuugcuguacuauucaacagcggcuaguucccucgccgugacccugaugcuugcaauauucaucgucuacauggugagccgugacaacgucucuuguucaauuugccuguga

SEQ ID NO: 150248 - RNA, 1758 nt, Artificial Sequence; identical to SEQ ID NO: 148661
  derived and/or modified sequence opt3 from hemagglutinin__InfluenzaB__AHM01459

SEQ ID NO: 150249 - RNA, 1755 nt, Artificial Sequence
  derived and/or modified sequence opt3 from hemagglutinin__InfluenzaB__AHM01470
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuuguacagaaggagaggaucagaucgcagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagcccacggcguggcugucgccgcagaccucaagucuacccaggaggccgugaauaagauaacuaaaaaccuuaauuccuuaagcgaacuggagguaaagaaccuccaacgacuuucgggugcuauggacgaacugcauaaugagaucuuggagcuagaugaaaaaguugacgaucugagagcggacaccauuucuucccagaucgagcucgcagugcugcuuucaaacgaagggauaauuaauagugaggaugaacaccuguuggcccucgagaggaagcugaaaaagauguuaggcccuagcgcugucgacaucggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccaucuugcuguacuauucaacagcagcgaguucccucgcugugacccugaugcuugccauuuucauagucuacauggugagccgugacaacguuucuuguucaaucugccuguga

SEQ ID NO: 150250 - RNA, 1755 nt, Artificial Sequence
  derived and/or modified sequence opt3 from hemagglutinin__InfluenzaB__AHM01481
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagagggucuggugcgcuucuggacgguccaaagugauuaaggguucacuuccauugaucggcgaagccgauugucugcaugagaaauacgggggacuaaacaagagcaaacccuacuauacuggcgaacacgcaaaggcuauugguaauugcccgaucuggguuaagaccccucucaaacuggccaacgggacaaaguaccgacccccagcgaaacuucugaaggagcgcggcuuuuucggagccaucgcaggcuuuuuggaagggggaugggaagguaugauugcuggcuggcacggguauacuucccauggagcccacggcguggcugucgccgcagaccucaaaucuacccaggaggccauaaauaagaucacaaagaaccugaauaguuuaagcgaacuggaggugaaaaaccuccaaagacuuucgggugcuauggacgaacugcauaaugagauuuuggagcuagaugaaaagguagacgaucugagggcggacaccaucucuucccagauagagcucgcaguucugcuuucaaacgaagggauuaucaauagugaggaugaacaccuguuggcccucgagcggaaacugaagaaaauguuaggcccuagcgcuguggacaucggaaacggcuguuucgagacuaagcacaagugcaaucagacgugccuggaucguauugccgcagggacauuuaacgccggagaguucucccuacccaccuuugacucucucaauaucacugcugccagccugaacgaugacggucuugauaaucauaccauuuugcuguacuauucaacagcagcgaguucccucgcugucacccugaugcuugccauauucaucguguacauggucagccgcgacaacgugucuuguucaauuugccuguga

SEQ ID NO: 150251 - RNA, 1755 nt, Artificial Sequence; identical to SEQ ID NO: 148915
  derived and/or modified sequence opt3 from hemagglutinin__InfluenzaB__AHM01492

SEQ ID NO: 150252 - RNA, 1755 nt, Artificial Sequence; identical to SEQ ID NO: 148870
  derived and/or modified sequence opt3 from hemagglutinin__InfluenzaB__AHM01503

SEQ ID NO: 150253 - RNA, 1755 nt, Artificial Sequence; identical to SEQ ID NO: 148870
  derived and/or modified sequence opt3 from hemagglutinin__InfluenzaB__AHM01514

SEQ ID NO: 150254 - RNA, 1755 nt, Artificial Sequence
  derived and/or modified sequence opt3 from hemagglutinin__InfluenzaB__AHM01525
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugauacaaaaacccggcaagaccggcacaauuguauaucagagagggguguuacugccucagaaagucuggugcgcuucuggaagguccaaggugaucaaagguucacuuccauugauuggcgaagccgauugucugcaugagaaguacgggggacuaaacaaaagcaagcccuacuauacuggcgaacacgcaaaggcuaucgguaauugcccgaucuggguuaaaaccccucucaagcuggccaacgggacaaaauaccggcccccagcgaagcugcugaaagagcgcggcuuuuucggagccauugcaggcuuuuuggaagggggaugggaagguaugauagcuggcuggcacggguauacaagucauggagcccacggcguggcugucgccgcagaccucaagucuacccaggaggccaucaauaagauuacuaaaaaccuuaauuccuuaagcgaacuggaggugaagaaccuccaacgacuuucgggugcuauggacgaacugcauaaugagaucuuggagcuagaugaaaaaguagacgaucugagagcggacaccauaucuucccagauugagcucgcaguucugcuuucaaacgaagggaucaucaauagugaggaugaacaccuguuggcccucgagaggaagcugaaaaagauguuaggcccuagcgcuguggacauuggaaacggcuguuucgagacuaagcacaaaugcaaucagacgugccuggaucggaucgccgcagggacauuuaacgccggagaguucucccuacccaccuuugacucucucaauauuacugcugccagccugaacgaugacggucuugauaaucauaccauauugcuguacuauucaacagcagcgaguucccucgcugucacccugaugcuugccaucuucauuguguacauggucagccgugacaacgugucuuguucaaucugccuguga

SEQ ID NO: 150255 - RNA, 1755 nt, Artificial Sequence
  derived and/or modified sequence opt3 from hemagglutinin__InfluenzaB__AHM01536
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccggcaagaccggcacaauaguauaucagagagggguguuacugccucagaaagucuggugcgcuucuggaagguccaaggugauuaaagguucacuuccauugaucggcgaagccgauugucugcaugagaaguacgggggacuaaacaaaagcaagcccuacuauacuggcgaacacgcaaaggcuauugguaauugcccgaucuggguuaaaaccccucucaagcuggccaacgggacaaaauaccggcccccagcgaagcugcugaaagagcgcggcuuuuucggagccaucgcaggcuuuuuggaagggggaugggaagguaugauugcuggcuggcacggguauacaagucauggagugcacggcgucgccguggcugccgaccucaagucuacccaggaggcaauaaauaagaucacuaaaaaccuuaauuccuuaagcgaacuggagguaaagaaccuccaacgacuuucgggugccauggacgaacugcauaaugagauuuuggagcuagaugaaaaaguugacgaucugagagcugacaccaucucuucccagauagagcucgcggugcugcuuucaaacgaagggauuaucaauagugaggaugaacaccuguuggcacucgagaggaagcugaaaaagauguuaggcccuagcgccgucgacaucggaaacggcuguuucgagacuaagcacaaaugcaaucagacgugccuggaucggauugcugccgggacauuuaacgcaggagaguucucccuacccaccuuugacucucucaauaucacugccgcuagccugaacgaugacggucuugauaaucauaccauuuugcuguacuauucaacagccgcaaguucccucgcggugacccugaugcuugcuauauucaucgucuacauggugagccgugacaacguuucuuguucaauuugccuguga

SEQ ID NO: 150256 - RNA, 1755 nt, Artificial Sequence; identical to SEQ ID NO: 148870
  derived and/or modified sequence opt3 from hemagglutinin__InfluenzaB__AHM01547

SEQ ID NO: 150257 - RNA, 1755 nt, Artificial Sequence; identical to SEQ ID NO: 148915
  derived and/or modified sequence opt3 from hemagglutinin__InfluenzaB__AHM01558

SEQ ID NO: 150258 - RNA, 1758 nt, Artificial Sequence; identical to SEQ ID NO: 148756
  derived and/or modified sequence opt3 from hemagglutinin__InfluenzaB__AHV83951

SEQ ID NO: 150259 - RNA, 1755 nt, Artificial Sequence; identical to SEQ ID NO: 150145
  derived and/or modified sequence opt3 from hemagglutinin__InfluenzaB__AHV83952

SEQ ID NO: 150260 - RNA, 1758 nt, Artificial Sequence; identical to SEQ ID NO: 148699
  derived and/or modified sequence opt3 from hemagglutinin__InfluenzaB__AHZ36697

SEQ ID NO: 150261 - RNA, 1758 nt, Artificial Sequence
  derived and/or modified sequence opt3 from hemagglutinin__InfluenzaB__AHZ36708
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugccucaauguuaccaacgggaauggauucuuugccacaauggcuugggcagugccuaaaaacgacaagaauaaaaccgccacgaacccacugacuauugaagucccguacaucuguacagagggugaggaucagauaaccguguggggcuuccacagugacaaugaaacucagauggcuaagcuguauggggauuccaagccccagaaauuuacaucuagcgccaacggagugaccacgcacuacgucucccaaauuggcgguuucccuaaccagaccgaggacgggggacucccacagucaggccgcaucguuguggauuauaugguacagaagaguggcaaaacagggacuauuaccuaccaaagaggaaucuuacugccccagaagguguggugcacaagcgguaggucuaaagucaucaagggcucccuuccuuugauuggggaagcggacugucugcaugagaaauauggaggccuaaauaagucaaagccauacuacacuggugagcacgcaaaagccauagggaacugccccaucugggugaagaccccgcucaaacuggcuaauggcacaaaguaucggccucccgccaaacuucugaaggaacgcggauuuuucggcgcaauugcuggguuuuuggagggagguugggaaggcaugaucgccggguggcauggauacaccagccacggcgcgcacgguguugccguggcagcugaucucaagaguacucaggaggccauaaacaaaauuacgaagaaucugaacucuuuauccgaacuggaggucaaaaaucuccagcgacuuagcggggcuauggacgagcugcauaacgaaaucuuggagcuagaugaaaagguggacgaccugagagccgauacaaucucgucucaaauugagcucgcaguacugcuuuccaaugaaggcaucauuaacucagaggacgagcaccuguuggcccucgaaaggaaacugaagaagauguuaggaccaagugcuguugagauaggcaauggguguuucgaaaccaaacauaagugcaaccagacuugccuggaucggaucgcggcaggaaccuuugacgccggugaguucagccuaccuacauuugauucccucaauauuaccgcugccucucugaacgacgauggccuugacaaucacacuaucuugcuguauuacagcacagcagccucaagucucgcugugacgcugaugaucgccauuuucgucguguauauggucucccgugauaacgugagcuguucuauaugccuuuga

SEQ ID NO: 150262 - RNA, 1758 nt, Artificial Sequence
  derived and/or modified sequence opt3 from hemagglutinin__InfluenzaB__AHZ36719
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacguguguacagagggugaggaucagaucaccguguggggcuuccacagugacaaugaaacucagauggcuaagcuguauggggauuccaagccucagaaauuuacaucuagcgccaacggagucaccacgcacuacguuucccaaauaggcgguuucccaaaccagaccgaggacgggggacugccccagucaggccgcauugugguagauuauauggugcagaagaguggcaaaacagggacuaucaccuaccaaagagguauucucuuaccucagaaggucuggugcgcgagcggaaggucuaaagugaucaagggcucccugccacuuaucggggaagcagacuguuugcaugagaaauauggaggccugaauaagucaaagcccuacuacacaggugagcacgccaaagcuauugggaacugcccgauauggguuaagacuccucuaaaacucgccaauggcaccaaguaucggcccccagcaaaacugcuuaaggaacgcggauuuuucggcgcuaucgccggguuucuggagggagguugggaaggcaugauugcgggguggcauggauacacaagccacggcgcccacgguguggcagucgcugccgauuugaagaguacccaggaggcuaucaacaaaauaacuaagaaucucaacucucuguccgaauuagaggugaaaaaucugcagcgacucagcggggccauggacgagcuucauaacgaaauucuggaguuggaugaaaagguagacgaccuaagagcagauacgaucucgucucaaaucgagcuggccguucuccuguccaaugaaggcauuaucaacucagaggacgagcaccuucuggcuuuggaaaggaaacucaagaagaugcugggaccuagugcgguggagauuggcaauggguguuucgaaacaaaacauaagugcaaccagaccugcuuagaucggauagcagccggaacuuuugacgcuggugaguucagccugcccaccuuugauucccuaaauaucacagccgcaucucucaacgacgauggccuggacaaucacaccauucuuuuguauuacagcacugccgcuucaagucuggccgucacacucaugaucgcaaucuucguggucuauauggugucccgugauaacguuagcuguucuauuugccuguga

SEQ ID NO: 150263 - RNA, 1758 nt, Artificial Sequence; identical to SEQ ID NO: 148699
  derived and/or modified sequence opt3 from hemagglutinin__InfluenzaB__AHZ36730

SEQ ID NO: 150264 - RNA, 1758 nt, Artificial Sequence; identical to SEQ ID NO: 148699
  derived and/or modified sequence opt3 from hemagglutinin__InfluenzaB__AHZ36752

SEQ ID NO: 150265 - RNA, 1758 nt, Artificial Sequence; identical to SEQ ID NO: 148661
  derived and/or modified sequence opt3 from hemagglutinin__InfluenzaB__AHZ36763

SEQ ID NO: 150266 - RNA, 1758 nt, Artificial Sequence
  derived and/or modified sequence opt3 from hemagglutinin__InfluenzaB__AHZ36774
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagucagcacccgggggaccuuauaagaucggcacuagcggcaguugcccaaacguuaccaaugggaacggauucuuugccacaauggcuugggcagugccgaaaaaugacaagaacaaaaccgccacggaucccuugacuauugaagucccuuacaucuguacagaggaggaagaccagauaaccgugugggguuuccacuccgauaaugagacucagauggcuaagcucuauggcgacucuaagccacagaaauuuacaagcuccgccaacggggugaccacgcacuacgucucacaaauuggaggcuuccccaaucagaccgaagauggugggcugccucagaguggacgcaucguuguggacuauaugguacaaaagagcggcaaaacaggcacuauuaccuaccagagagggauccugcucccacagaagguguggugcgcgucuggaagguccaaagucaucaaggguucauuaccccugauuggcgaggcagauugucuucaugagaaauaugggggauugaacaagagcaagccguacuacacaggcgaacacgccaaagcuauagguaacugcccuaucugggugaagacuccccugaaacuagccaaugggaccaaguaucggccuccagcaaaacuccugaaggagcgcggcuuuuucggagcuauugccggcuuucuugaagggggaugggaggguaugaucgcgggcuggcauggguacacaagucacggagcccacggcguugcaguggcugccgaccugaagucuacccaggaagcuauaaacaaagucacuaagaauuugaacucccucagcgagcuggaggugaaaaauuuacagcgacugucgggugccauggaugaacuccauaacgagauucuugaacuggacgagaagguagacgauuugagagcagacacgaucucuucccaaaucgaacuagccguucugcucucaaaugaggggauuaucaacagugaggaugaacaucugcuugcucuggagaggaaauugaagaagaugcucggccccagcgcgguggaaauuggaaauggcuguuucgagacaaaacacaagugcaaccagaccugccuggaccggauagcagccgggacuuuugaugcuggagaguucuccuuaccaaccuuugacucucugaauaucacagccgcaagccuaaacgaugacggucucgauaaucacaccauucugcuuuauuacucaacugccgcuaguuccuuggccgucacacugaugaucgcaaucuucguggucuauauggugagccgugacaacguuucuuguucaauuugccucuga

SEQ ID NO: 150267 - RNA, 1758 nt, Artificial Sequence; identical to SEQ ID NO: 150175
  derived and/or modified sequence opt3 from hemagglutinin__InfluenzaB__AHZ36785

SEQ ID NO: 150268 - RNA, 1758 nt, Artificial Sequence; identical to SEQ ID NO: 150175
  derived and/or modified sequence opt3 from hemagglutinin__InfluenzaB__AHZ36796

SEQ ID NO: 150269 - RNA, 1755 nt, Artificial Sequence
  derived and/or modified sequence opt3 from hemagglutinin__InfluenzaB__AHZ36807
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagacggaggauggugggcucccacagagcggacgcaucguuguggacuacaugaugcaaaaacccgaaaagaccggcacaauaguauaucagagaggcguguuacugccucagaaagucuggugcgcuucugggagguccaaggugauuaaaggaucacuuccauugaucggugaggccgauugucugcaugaaaaguacggcgggcuaaacaaaagcaagcccuacuauacuggagagcacgcaaaggcuauuggcaauugcccgaucuggguuaaaaccccucucaagcuggccaacgguacaaaauaccggcccccagcgaagcugcugaaagagcgcggguuuuucggcgccaucgcaggauuuuuggaaggcgggugggagggaaugauugcugguuggcacggcuauacaagucauggggcccacggaguggcugucgccgcagaccucaagucuacccaggaagccauaaauaagaucacuaaaaaccuuaauuccuuaagcgagcuggaagugaagaaccuccaacgacuuucgggcgcuauggacgagcugcauaaugagauuuuggaacuagaugagaaaguagacgaucugagagcggacaccaucucuucccagauagaacucgcaguucugcuuucaaacgaggguauuaucaauagugaagaugagcaccuguuggcccucgagaggaagcugaaaaagauguuagggccuagcgcuguggacaucggcaacggauguuucgaaacuaagcacaaaugcaaucagacgugccuggaucggauugccgcaggcacauuuaacgccggggaguucucccuacccaccuuugacucucucaauaucacugcugccagccugaacgaugacggacuugauaaucauaccauuuugcuguacuauucaacagcagcgaguucccucgcugucacccugaugcuugccauauucaucguguacauggucagccgugacaacgugucuuguucaauuugccuguga

SEQ ID NO: 150270 - RNA, 1758 nt, Artificial Sequence; identical to SEQ ID NO: 148699
  derived and/or modified sequence opt3 from hemagglutinin__InfluenzaB__AHZ36818

SEQ ID NO: 150271 - RNA, 1758 nt, Artificial Sequence; identical to SEQ ID NO: 148661
  derived and/or modified sequence opt3 from hemagglutinin__InfluenzaB__AHZ36829

SEQ ID NO: 150272 - RNA, 1758 nt, Artificial Sequence; identical to SEQ ID NO: 148661
  derived and/or modified sequence opt3 from hemagglutinin__InfluenzaB__AHZ36840

SEQ ID NO: 150273 - RNA, 1758 nt, Artificial Sequence; identical to SEQ ID NO: 150175
  derived and/or modified sequence opt3 from hemagglutinin__InfluenzaB__AHZ36851

SEQ ID NO: 150274 - RNA, 1758 nt, Artificial Sequence; identical to SEQ ID NO: 148699
  derived and/or modified sequence opt3 from hemagglutinin__InfluenzaB__AHZ36862

SEQ ID NO: 150275 - RNA, 1758 nt, Artificial Sequence; identical to SEQ ID NO: 148661
  derived and/or modified sequence opt3 from hemagglutinin__InfluenzaB__AHZ36873

SEQ ID NO: 150276 - RNA, 1758 nt, Artificial Sequence
  derived and/or modified sequence opt3 from hemagglutinin__InfluenzaB__AHZ36884
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugaaacaauggccugggcuguaccgaaaaacgacaagaauaaaaccgcaacgaacccacucacuauagagguucccuacauuuguacagagggugaagaucagaucaccguguggggcuuccacagugacaaugagacucagauggccaagcuguauggggauuccaagccucagaaauuuacaucuagcgcuaacggagucaccacgcacuacgugucccaaauuggcgguuucccaaaccagaccgaagacgggggacugccccagucaggccgcaucguggucgauuauaugguucagaagaguggcaaaacagggacuaucaccuaccaaagagguauucucuuaccucagaagguguggugcgccagcggaaggucuaaaguaauaaagggcucccugccacuuaucggggaggcggacuguuugcaugagaaauauggaggccugaauaagucaaagcccuacuacacaggugaacacgcaaaagccauugggaacugcccgaucugggugaagacuccucuaaaacucgcuaauggcaccaaguaucggcccccagccaaacugcuuaaggagcgcggauuuuucggcgcaauagcuggguuucuggaaggagguugggagggcaugauugccggguggcauggauacacaagccacggcgcgcacggugucgccguggcagcugauuugaagaguacccaggaagccaucaacaaaaucacuaagaaucucaacucucuguccgaguuagagguuaaaaaucugcagcgacucagcggggcuauggacgaacuucauaacgagauucuggaauuggaugagaagguggacgaccuaagagccgauacgaucucgucucaaauugaacuggcaguccuccuguccaaugagggcauaaucaacucagaggacgaacaccuucuggccuuggagaggaaacucaagaagaugcugggaccuagugcuguggaaauuggcaauggguguuucgagacaaaacauaagugcaaccagaccugcuuagaucggaucgcggcaggaacuuuugacgccggugaguucagccugcccaccuuugauucccuaaauaucacagcugccucucucaacgacgauggccuggacaaucacaccauucuuuuguauuacagcacugcagccucaagucuggcuguaacacucaugauagccaucuucguuguguauauggucucccgugauaacgugagcuguucuauuugccuguga

SEQ ID NO: 150277 - RNA, 1758 nt, Artificial Sequence; identical to SEQ ID NO: 148699
  derived and/or modified sequence opt3 from hemagglutinin__InfluenzaB__AHZ36895

SEQ ID NO: 150278 - RNA, 1758 nt, Artificial Sequence; identical to SEQ ID NO: 148699
  derived and/or modified sequence opt3 from hemagglutinin__InfluenzaB__AHZ36906

SEQ ID NO: 150279 - RNA, 1758 nt, Artificial Sequence
  derived and/or modified sequence opt3 from hemagglutinin__InfluenzaB__AHZ36928
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacuaagacaaggggcaaauuguguccgaagugcuuaaacuguaccgaucuggacguugcgcuagggcggcccaagugcacgggaaaaaucccuagcgcucgcguguccauucuccacgaaguccgaccagugacuucuggcuguuuucccaucaugcaugaucguaccaagauaagacaacugccuaaucuucugagggguuacgagcacauccgguugucgacacauaacguaauuaaugccgaaaacgcaccagggggacccuauaaaaucggcacuucaggcagcugccucaauguuaccaacgggaauggauucuuugccacaauggcuugggcagugccuaagaacgacaaaaauaagaccgccacgaacccacugacuauugaggucccguacaucuguacagaaggugaggaucagauaaccguguggggcuuccacagugacaaugagacucagauggcuaagcuguauggggauuccaaaccccagaaguuuacaucuagcgccaacggagugaccacgcacuacgucucccaaauuggcgguuucccuaaccagaccgaagacgggggacucccacagucaggccgcaucguuguggauuauaugguacagaaaaguggcaagacagggacuauuaccuaccaaagaggaaucuuacugccccagaaaguguggugcgcgagcgguaggucuaaggucaucaaaggcucccuuccuuugauuggggaggcagacugucugcaugaaaaguauggaggccuaaauaagucaaaaccauacuacacaggugagcacgccaaggcuauagggaacugccccaucugggugaaaacuccgcucaagcuggccaauggcaccaaauaucggccucccgcaaaacuucugaaggagcgcggauuuuucggcgcuauugccggguuuuuggaaggagguugggagggcaugaucgcgggguggcauggauacacaagccacggcgcccacgguguugcaguggcugccgaucucaagaguacccaggaagcuauaaacaagauuacuaaaaaucugaacucuuuauccgagcuggaagucaagaaucuccagcgacuuagcggggccauggacgagcugcauaacgagaucuuggaacuagaugagaaaguggacgaccugagagcagauacgaucucgucucaaauugaacucgccguacugcuuuccaaugagggcaucauuaacucagaagacgagcaccuguuggcucucgagaggaagcugaagaaaauguuaggaccaagugcgguugaaauaggcaauggguguuucgagacaaagcauaaaugcaaccagaccugccuggaucggaucgcagccggaacuuuugacgcuggugaguucagccuaccuaccuuugauucccucaauauuacagccgcaucucugaacgacgauggccuugacaaucacaccaucuugcuguauuacagcacugccgcuucaagucucgccgugacacugaugaucgcaauuuucgucguguauauggucucccgugauaacgugagcuguucuauaugccuuuga

SEQ ID NO: 150280 - RNA, 1758 nt, Artificial Sequence; identical to SEQ ID NO: 150175
  derived and/or modified sequence opt3 from hemagglutinin__InfluenzaB__AHZ36939

SEQ ID NO: 150281 - RNA, 1758 nt, Artificial Sequence
  derived and/or modified sequence opt3 from hemagglutinin__InfluenzaB__AHZ36950
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccaauaacuucuggcuguuuucccaucaugcaugaucguaccaaaauuagacaacugccuaaucuucugagggguuacgaacacauccgguugucgacacauaacgucauuaaugccgagaacgcaccagggggacccuauaagaucggcacuucaggcagcugcccuaauauaaccaacgggaauggauucuuugccacaauggcuugggcagugccgaaaaacgacaagaauaaaaccgccacgaacccacucacuauugaaguacccuacaucuguacagagggugaggaucagauuaccguuuggggcuuccacagugacaaugaaacucagauggcuaagcuguauggggauuccaagccucagaaauuuacaucuagcgccaacggagugaccacgcacuacgucucccaaaucggcgguuucccaaaccagaccgaggacgggggacugccccagucaggccgcaucgugguggauuauaugguccagaagaguggcaaaacagggacuauuaccuaccaaagaggaauacucuuaccucagaagguuuggugcgcgagcgguaggucuaaagugaucaagggcucccugccacuuauuggggaagcagacuguuugcaugagaaauauggaggccugaauaagucaaagcccuacuacacaggugagcacgccaaagcuaucgggaacugcccgauauggguaaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguggcagucgcugccgauuugaagaguacccaggaggcuaucaacaaaauuacuaagaaucucaacucucuguccgaauuagaggugaaaaaucugcagcgacucagcggggccauggacgagcuucauaacgaaauccuggaguuggaugaaaagguugacgaccuaagagcagauacgauuucgucucaaauagagcuggccgugcuccuguccaaugaaggcaucauuaacucagaggacgagcaccuucuggcuuuggaaaggaaacucaagaagaugcugggaccuagugcggucgagaucggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauacuuuuguauuacagcacugccgcuucaagucuggccgugacacucaugaucgcaauuuucguaguuuauauggugucccgugauaacgucagcuguucuaucugccuguga

SEQ ID NO: 150282 - RNA, 1758 nt, Artificial Sequence
  derived and/or modified sequence opt3 from hemagglutinin__InfluenzaB__AHZ36961
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguggcucuaaagucaucaaggggucccugccacuuauuggagaagcagacuguuugcaugagaaauauggcggucugaauaagucaaagcccuacuacacaggggagcacgccaaagcuauaggcaacugcccgaucugggugaagacuccucuaaaacucgccaauggaaccaaguauaggcccccagcaaaacugcuuaaggaacggggcuuuuucggggcuauugccggauuucuggaggguggcugggaagggaugaucgcgggauggcauggcuacacaagccacggugcccacgggguugcaguggcugccgauuugaagaguacccaggaggcuauaaacaaaauuacuaagaaucucaacucucuguccgaauuagaggucaaaaaucugcagcgccucagcggcgccauggacgagcuucauaacgaaauccuggaguuggaugaaaagguggacgaccuacgagcagauacgaucucgucucaaauugagcuggccguacuccuguccaaugaaggaaucauuaacucagaggacgagcaccuucuggcuuuggaaagaaaacucaagaagaugcugggcccuagugcgguugagauagggaauggauguuucgaaacaaaacauaagugcaaccagaccugcuuagauaggaucgcagccgguacuuuugacgcuggcgaguucagccugcccaccuuugauucccuaaauauuacagccgcaucucucaacgacgaugggcuggacaaucacaccauccuuuuguauuacagcacugccgcuucaagucuggccgugacacucaugaucgcaauuuucgucguguauauggucucccgggauaacgugagcuguucuauaugccuguga

SEQ ID NO: 150283 - RNA, 1758 nt, Artificial Sequence; identical to SEQ ID NO: 148699
  derived and/or modified sequence opt3 from hemagglutinin__InfluenzaB__AHZ36972

SEQ ID NO: 150284 - RNA, 1758 nt, Artificial Sequence
  derived and/or modified sequence opt3 from hemagglutinin__InfluenzaB__AHZ36983
augaaggccaucauugugcugcucauggucguuaccagcaacgcugacagaauaugcacaggcaucacuuccucuaauucaccccacauugugaaaacggcaacccagggggagguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccacgaacccacucacuauagaaguucccuacauuuguacagagggugaggaucagaucaccguguggggcuuccacagugacaaugaaacucagauggcuaagcuguauggggauuccaagccucagaaauuuacaucuagcgccaacggagucaccgcgcacuacgugucccaaauuggcgguuucccaaaccagacggaggacgggggacugccccagucaggccgcaucguggucgauuauaugguucagaagaguggcaaaaccgggacaaucacuuaccaaagagguauucucuuaccucagaagguguggugcgcaagcggaaggucuaaaguaauaaagggcucccugccacuuaucggggaagccgacuguuugcaugagaaauauggaggccugaauaagucaaagcccuacuacaccggugagcacgcuaaagccauugggaacugcccgaucugggugaagacaccucuaaaacucgcaaauggcacuaaguaucggcccccagcuaaacugcuuaaggaacgcggauuuuucggcgccauagcgggguuucuggagggagguugggaaggcaugauugccggguggcauggauacaccagccacggcgcacacggugucgcuguggccgcugauuugaagaguacacaggaggccaucaacaaaaucaccaagaaucucaacucucuguccgaauuagagguuaaaaaucugcagcgacucagcggggcaauggacgagcuucauaacgaaauucuggaguuggaugaaaagguggacgaccuaagagccgauacuaucucgucucaaauugagcuggcuguccuccuguccaaugaaggcauaaucaacucagaggacgagcaccuucuggcguuggaaaggaaacucaagaagaugcugggaccuagugcaguggagauuggcaauggguguuucgaaacgaaacauaagugcaaccagacaugcuuagaucggaucgccgcuggaaccuuugacgccggugaguucagccugcccacuuuugauucccuaaauaucaccgcagccucucucaacgacgauggccuggacaaucacacaauucuuuuguauuacagcaccgcugccucaagucuggcaguaacucucaugauagcgaucuucguuguguauauggucucccgugauaacgugagcuguucuauuugccuguga

SEQ ID NO: 150285 - RNA, 1758 nt, Artificial Sequence
  derived and/or modified sequence opt3 from hemagglutinin__InfluenzaB__AHZ37005
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagucagcacccgggggaccuuauaagaucggcacuagcggcaguugcccaaacguuaccaaugggaacggauucuuugccacaauggcuugggcagugccgaaaaaugacaagaacaaaaccgccacggaucccuugacuauugaagucccuuacaucuguacagaggaggaagaccagauaaccgugugggguuuccacuccgauaaugagacucagauggcuaagcucuauggcgacucuaagccacagaaauuuacaagcuccgccaacggggugaccacgcacuacgucucacaaauuggaggcuuccccaaucagaccgaagauggugggcugccucagaguggacgcaucguuguggacuauaugguacaaaagagcggcaaaacaggcacuauuaccuaccagagagggauccugcucccacagaagguguggugcgcgucuggaagguccaaagucaucaaggguucauuaccccugauuggcgaggcagauugucuucaugagaaauaugggggauugaacaagagcaagccguacuacacaggcgaacacgccaaagcuauagguaacugcccuaucugggugaagacuccccugaaacuagccaaugggaccaaguaucggccuccagcaaaacuccugaaggagcgcggcuuuuucggagcuauugccggcuuucuugaagggggaugggaggguaugaucgcgggcuggcauggguacacaagucacggagcccacggcguugcaguggcugccgaccugaagucuacccaggaagcuauaaacaaaauuacuaagaauuugaacucccucagcgagcuggaggucaaaaauuuacagcgacugucgggugccauggaugaacuccauaacgagauccuugaacuggacgagaagguggacgauuugagagcagacacgaucucuucccaaauugaacuagccguacugcucucaaaugaggggaucauuaacagugaggaugaacaucugcuugcucuggagaggaaauugaagaagaugcucggccccagcgcgguugaaauaggaaauggcuguuucgagacaaaacacaagugcaaccagaccugccuggaccggaucgcagccgggacuuuugaugcuggagaguucuccuuaccaaccuuugacucucugaauauuacagccgcaagccuaaacgaugacggucucgauaaucacaccauccugcuuuauuacucaacugccgcuaguuccuuggccgugacacugaugaucgcaauuuucgucguguauauggucagccgugacaacgugucuuguucaauaugccucuga

SEQ ID NO: 150286 - RNA, 1758 nt, Artificial Sequence; identical to SEQ ID NO: 148661
  derived and/or modified sequence opt3 from hemagglutinin__InfluenzaB__AHZ37016

SEQ ID NO: 150287 - RNA, 1758 nt, Artificial Sequence
  derived and/or modified sequence opt3 from hemagglutinin__InfluenzaB__AHZ37027
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauuauccacgagguccgaccagugacuucuggcuguuuucccauaaugcaugaucguaccaaaaucagacaacucccuaaucugcuuagggguuacgaacacauucggcugucgacacauaacguaaucaaugccgagaacgcaccagggggacccuauaagauuggcacuucaggcagcugcuugaauguuaccaacgggaauggauucuuugccacaauggcuugggcagugccuaaaaacgacaagaauaaaaccgccacgaacccacucacuaucgaagucccguacauauguacagagggugaggaucagauuaccguguggggcuuccacagugacaaugaaacucagauggcuaagcuguauggggauuccaagccccagaaauuuacaucuagcgccaacggagugaccacgcacuacgucucccaaaucggcgguuucccuaaccagaccgaggacgggggacugccacagucaggccgcauuguuguggauuauaugguacagaagaguggcaaaacagggacuaucaccuaccaaagaggaauccucuuaccccagaagguguggugcgcgagcgguaggucuaaagucauuaagggcucccugccucuuauaggggaagcagacuguuugcaugagaaauauggaggccugaauaagucaaagccauacuacacaggugagcacgccaaagcuaucgggaacugccccauuugggugaagacuccgcuaaaacucgccaauggcaccaaguaucggccucccgcaaaacugcuuaaggaacgcggauuuuucggcgcuaucgccggguuucuggagggagguugggaaggcaugauagcgggguggcauggauacacaagccacggcgcccacgguguugcaguggcugccgauuugaagaguacccaggaggcuauuaacaaaaucacuaagaaucucaacucucuguccgaauuagaggucaaaaaucugcagcgacucagcggggccauggacgagcuucauaacgaaauccuggaguuggaugaaaagguggacgaccuaagagcagauacgauuucgucucaaaucgagcuggccguacuccuguccaaugaaggcauuauaaacucagaggacgagcaccuucuggcuuuggaaaggaaacucaagaagaugcugggaccaagugcgguugagaucggcaauggguguuucgaaacaaaacauaagugcaaccagaccugcuuagaucggauugcagccggaacuuuugacgcuggugaguucagccugccuaccuuugauucccuaaauaucacagccgcaucucucaacgacgauggccuggacaaucacaccauccuuuuguauuacagcacugccgcuucaagucuggccgugacacucaugauugcaauauucgucguguauauggucucccgugauaacgugagcuguucuaucugccuguga

SEQ ID NO: 150288 - RNA, 1758 nt, Artificial Sequence; identical to SEQ ID NO: 148661
  derived and/or modified sequence opt3 from hemagglutinin__InfluenzaB__AHZ37038

SEQ ID NO: 150289 - RNA, 1758 nt, Artificial Sequence; identical to SEQ ID NO: 150175
  derived and/or modified sequence opt3 from hemagglutinin__InfluenzaB__AHZ37049

SEQ ID NO: 150290 - RNA, 1758 nt, Artificial Sequence; identical to SEQ ID NO: 150175
  derived and/or modified sequence opt3 from hemagglutinin__InfluenzaB__AHZ37060

SEQ ID NO: 150291 - RNA, 1758 nt, Artificial Sequence; identical to SEQ ID NO: 148661
  derived and/or modified sequence opt3 from hemagglutinin__InfluenzaB__AHZ37071

SEQ ID NO: 150292 - RNA, 1758 nt, Artificial Sequence; identical to SEQ ID NO: 148661
  derived and/or modified sequence opt3 from hemagglutinin__InfluenzaB__AHZ37082

SEQ ID NO: 150293 - RNA, 1758 nt, Artificial Sequence; identical to SEQ ID NO: 150175
  derived and/or modified sequence opt3 from hemagglutinin__InfluenzaB__AHZ37093

SEQ ID NO: 150294 - RNA, 1758 nt, Artificial Sequence
  derived and/or modified sequence opt3 from hemagglutinin__InfluenzaB__AHZ37104
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggaucauaugguacagaagaguggcaaaacagggacuauuaccuaucaaagaggaauccucuuaccucagaagguguggugcgcgagcgguaggucuaaagucaucaagggcucccugccacuuauuggggaagcagacuguuugcacgagaaauacggaggccugaauaagucaaagcccuauuacacaggugagcaugccaaagcuauagggaacugcccgaucugggugaagacuccucuaaaacucgccaauggcaccaaguaccggcccccagcaaaacugcuuaaggaacgcggauuuuucggcgcuauugccggguuucuggagggagguugggaaggcaugaucgcgggguggcacggauauacaagccacggcgcccaugguguugcaguggcugccgauuugaagaguacccaggaggcuauaaacaaaauuacuaagaaucucaacucucuguccgaauuagaggucaaaaaucugcagcgacucagcggggccauggacgagcuucacaacgaaauccuggaguuggaugaaaagguggacgaccuaagagcagauacgaucucgucucaaauugagcuggccguacuccuguccaaugaaggcaucauuaacucagaggacgagcaucuucuggcuuuggaaaggaaacucaagaagaugcugggaccuagugcgguugagauaggcaauggguguuucgaaacaaaacacaagugcaaccagaccugcuuagaucggaucgcagccggaacuuuugacgcuggugaguucagccugcccaccuuugauucccuaaauauuacagccgcaucucucaacgacgauggccuggacaaucauaccauccuuuuguacuauagcacugccgcuucaagucuggccgugacacucaugaucgcaauuuucgucguguacauggucucccgugauaacgugagcuguucuauaugccuguga

SEQ ID NO: 150295 - RNA, 1758 nt, Artificial Sequence
  derived and/or modified sequence opt3 from hemagglutinin__InfluenzaB__AHZ41770
augaaggccaucauugugcugcucauggucguuaccagcaacgcugacagaauaugcacaggcaucacuuccucuaauucaccccacauugugaaaacggcaacccagggggaaguaaacgugacaggagucaucccucuuacuaccacaccaaccaagagucauuucgccaaucugaaagguacugaaacaaggggcaaguuguguccgaaaugcuuaaacuguaccgaucuggacguggcgcuagggcggcccaagugcacgggaaagauuccuagcgcucgcguuuccauccuccacgaggugcgaccagucacuucuggcuguuuucccauaaugcaugaucguaccaaaaucagacaacugccuaaucuucugagggguuacgaacacauucgguugucgacacauaacgugaucaaugccgagaacgcaccagggggacccuauaagauuggcacuucaggcagcugcccuaauaucaccaacgggaauggauucuuugccacaauggcuugggcaguaccgaaaaacgacaagaauaaaaccgccauaaacccacucacgauugaaguucccuacaucuguacugagggugaggaucagauuacaguguggggcuuccacagugacaaugaaacccagauggcuaagcuguauggggauuccgagccucagaaguuuacuucuagcgccaacggagucacaacccacuacgugucccaaaucggcgguuucccaaaccagacggaagacgggggacugccccagucaggccgcaucguggucgauuauaugguucagaaaaguggcaagaccgggacaauuacuuaccaaagaggaauacucuuaccucagaaaguguggugcgcgagcgguaggucuaagguaaucaaaggcucccugccacuuauuggggaggcagacuguuugcaugagaaguauggaggccugaauaaaucaaagcccuacuacaccggugaacacgccaaggcuaucgggaacugcccgauaugggugaaaacaccucuaaagcucgccaauggcacuaaauaucggcccccagcaaagcugcuuaaagagcgcggauuuuucggcgcuauugccggguuucuggaaggagguugggagggcaugaucgcgggguggcauggauacaccagccacggcgcccacggugucgcaguggcugccgauuugaagaguacacaggaagcuaucaacaagauuaccaaaaaucucaacucucuguccgaguuagagguuaagaaucugcagcgacucagcggggccauggacgaacuucauaacgagauccuggaauuggaugagaaaguggacgaccuaagagcagauacuauuucgucucaaauagaacuggccguccuccuguccaaugagggcaucauuaacucagaggacgaacaccuucuggcuuuggagaggaagcucaaaaagaugcugggaccuagugcgguggaaaucggcaauggguguuucgagacgaagcauaaaugcaaccagacaugcuuagaucggaucgcagccggaaccuuugacgcuggugaguucagccugcccacuuuugauucccuaaauauuaccgccgcaucucucaacgacgauggccuggacaaucacacaauacuuuuguauuacagcaccgccgcuucaagucuggccguaacucucaugaucgcaauuuucguuguguauauggucucccgugauaacgugagcuguucuaucugccuguga

SEQ ID NO: 150296 - RNA, 1758 nt, Artificial Sequence; identical to SEQ ID NO: 148699
  derived and/or modified sequence opt3 from hemagglutinin__InfluenzaB__AHZ41781

SEQ ID NO: 150297 - RNA, 1758 nt, Artificial Sequence; identical to SEQ ID NO: 148699
  derived and/or modified sequence opt3 from hemagglutinin__InfluenzaB__AHZ41792

SEQ ID NO: 150298 - RNA, 1758 nt, Artificial Sequence; identical to SEQ ID NO: 148699
  derived and/or modified sequence opt3 from hemagglutinin__InfluenzaB__AHZ41803

SEQ ID NO: 150299 - RNA, 1758 nt, Artificial Sequence
  derived and/or modified sequence opt3 from hemagglutinin__InfluenzaB__AHZ41814
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaagccacagaaauuuacaucuagcgccaacggagugaccacgcacuacgucucccaaauuggcgguuuccccaaccagaccgaggacgggggacugccucagucaggccgcaucguuguggauuauaugguacagaagaguggcaaaacagggacugugaccuaccaaagagguauucugcucccacagaaggucuggugcgcgagcggaaggucuaaagugaucaagggcuccuuaccccugaucggggaagcagacugucuucaugagaaauauggaggcuugaauaagucaaagccguacuacacaggugagcacgccaaagcuauugggaacugcccuauauggguuaagacuccccugaaacuagccaauggcaccaaguaucggccuccagcaaaacuccugaaggaacgcggauuuuucggcgcuaucgccggguuucuugagggagguugggaaggcaugauugcgggguggcauggauacacaagccacggcgcccacgguguggcagucgcugccgaucugaagaguacccaggaggcuaucaacaaaauaacuaagaauuugaacucucucuccgaacuggaggugaaaaauuuacagcgacugagcggggccauggacgagcuccauaacgaaauucuugagcuggaugaaaagguagacgacuugagagcagauacgaucucgucucaaaucgagcuagccguucugcucuccaaugaaggcauuaucaacucagaggacgagcaucugcuugcucuggaaaggaaauugaagaagaugcucggacccagugcgguggagauuggcaauggguguuucgaaacaaaacacaagugcaaccagaccugccuggaucggauagcagccggaacuuuugacgcuggugaguucagcuuaccaaccuuugauucccugaauaucacagccgcaucucuaaacgacgauggccucgacaaucacaccauucugcuuuauuacagcacugccgcuucaaguuuggccgucacacugaugaucgcaaucuucguggucuauauggugucccgugauaacguuagcuguucuauuugccucuga

SEQ ID NO: 150300 - RNA, 1758 nt, Artificial Sequence; identical to SEQ ID NO: 148699
  derived and/or modified sequence opt3 from hemagglutinin__InfluenzaB__AHZ41825

SEQ ID NO: 150301 - RNA, 1758 nt, Artificial Sequence; identical to SEQ ID NO: 148699
  derived and/or modified sequence opt3 from hemagglutinin__InfluenzaB__AHZ41836

SEQ ID NO: 150302 - RNA, 1758 nt, Artificial Sequence; identical to SEQ ID NO: 148699
  derived and/or modified sequence opt3 from hemagglutinin__InfluenzaB__AHZ41847

SEQ ID NO: 150303 - RNA, 1755 nt, Artificial Sequence; identical to SEQ ID NO: 150147
  derived and/or modified sequence opt3 from hemagglutinin__InfluenzaB__AHZ41858

SEQ ID NO: 150304 - RNA, 1758 nt, Artificial Sequence; identical to SEQ ID NO: 150172
  derived and/or modified sequence opt3 from hemagglutinin__InfluenzaB__AHZ41869

SEQ ID NO: 150305 - RNA, 1755 nt, Artificial Sequence
  derived and/or modified sequence opt3 from hemagglutinin__InfluenzaB__AIC73844
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgaucuucauuguguauauggucagccgcgacaaugugucuuguucaaucugccuuuga

SEQ ID NO: 150306 - RNA, 1758 nt, Artificial Sequence; identical to SEQ ID NO: 149881
  derived and/or modified sequence opt3 from hemagglutinin__InfluenzaB__AIC73845

SEQ ID NO: 150307 - RNA, 1758 nt, Artificial Sequence; identical to SEQ ID NO: 149881
  derived and/or modified sequence opt3 from hemagglutinin__InfluenzaB__AIC73846

SEQ ID NO: 150308 - RNA, 1758 nt, Artificial Sequence
  derived and/or modified sequence opt3 from hemagglutinin__InfluenzaB__AIC73847
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuagauuguaccgaccuggauguugcgcuagggcggcccaagugcacgggaaagaucccuagcgcucgcguguccauucuccacgagguccgaccagugacuucuggcuguuuucccaucaugcaugaccguaccaaaauaagacaacugccuaaccuucugagggguuacgaacacauccgguugucgacacauaauguaauuaacgccgaggaugcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaucagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaacaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggacgaaaagguggaugaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagaucggaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgugauaacgugagcuguucuauaugccuguga

SEQ ID NO: 150309 - RNA, 1758 nt, Artificial Sequence; identical to SEQ ID NO: 149881
  derived and/or modified sequence opt3 from hemagglutinin__InfluenzaB__AIC73848

SEQ ID NO: 150310 - RNA, 1755 nt, Artificial Sequence; identical to SEQ ID NO: 150145
  derived and/or modified sequence opt3 from hemagglutinin__InfluenzaB__AIC73849

SEQ ID NO: 150311 - RNA, 1758 nt, Artificial Sequence
  derived and/or modified sequence opt3 from hemagglutinin__InfluenzaB__AIC73850
augaaggccaucauugugcugcucauggucgcuaccagcaacgcagacagaauaugcacaggcaucacuuccucuaauucaccccacguugugaaaacggccacccagggggagguaaacgugacaggagucauuccucuuacuaccacaccaaccaagagucauuucgcgaaucugaaagguacugaaacaaggggcaaguuguguccgaaaugcuuaaacuguaccgaucuggacguggcucuagggcggcccaagugcacgggaaagaucccuagcgcccgcguuuccauucuccacgaggugcgaccagucacuucuggcuguuuucccaucaugcaugaucguaccaaaauaagacaacugccuaaucuucugagggguuacgaacacauccgguugucgacacauaacgugauuaaugcagaggacgccccagggggacccuauaagaucggcacuucaggcagcugcccuaacguaaccaaugggaacggauucuuugcuacaauggcaugggccguuccgaaaaaugauaagaacaaaaccgcuacgaauccacucacuauugaagugcccuacaucuguacagagggugaggaccagauaaccgucuggggcuuccacagugauaacgaaacucagauggccaagcuguauggggacuccaagccucagaaauuuacaucuagcgcgaauggagugaccacgcacuacgugucccaaauuggcgguuucccaaaccagaccgaggaugggggacugccccagucaggccgcaucgucguugacuauauggugcagaagaguggcaaaacagggacuauuaccuaccaaagaggaauccucuuaccucagaagguauggugcgcaagcgguaggucuaaagugaucaagggcucccugccacuuauuggggaagccgauuguuugcaugagaaauauggaggccugaacaagucaaagcccuacuacacaggugagcacgcuaaagccauagggaauugcccgaucugggucaagacuccucuaaaacucgcaaacggcaccaaguaucggcccccagcuaaacugcuuaaggaacgcggauuuuucggcgccauugcgggguuucuggagggagguugggaaggcaugaucgccggguggcauggauacacaagccacggcgcacacgguguggcuguugccgcugacuugaagaguacccaggaggccauaaauaaaauuacuaagaaccucaauucucuguccgaauuagaggugaaaaaccugcagcgacucagcggggcaauggaugagcuucauaaugaaauccuggaguuggacgaaaaggucgacgaucuaagagccgacacgaucucgucucaaauugagcuggcugugcuccuguccaacgaaggcaucauuaauucagaggaugagcaccuucuggcguuggaaaggaaacucaagaagaugcugggaccuagugcaguagagauaggcaacggguguuucgaaacaaaacauaagugcaaucagaccugcuuagaccggaucgccgcuggaacuuuugaugccggugaguucagccugcccaccuuugacucccuaaacauuacagcagccucucucaaugaugacggccuggauaaccacaccauccuuuuguauuacagcacugcugccucaagucuggcaguuacacucaugaucgcgauuuucguggucuauauggugucccgugacaaugucagcuguucuauaugccuguga

SEQ ID NO: 150312 - RNA, 1758 nt, Artificial Sequence; identical to SEQ ID NO: 148903
  derived and/or modified sequence opt3 from hemagglutinin__InfluenzaB__AIC73851

SEQ ID NO: 150313 - RNA, 1755 nt, Artificial Sequence; identical to SEQ ID NO: 150305
  derived and/or modified sequence opt3 from hemagglutinin__InfluenzaB__AIC73852

SEQ ID NO: 150314 - RNA, 1755 nt, Artificial Sequence; identical to SEQ ID NO: 150305
  derived and/or modified sequence opt3 from hemagglutinin__InfluenzaB__AIC73853

SEQ ID NO: 150315 - RNA, 1758 nt, Artificial Sequence
  derived and/or modified sequence opt3 from hemagglutinin__InfluenzaB__AIC73855
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaucauuggcacuucaggcagcugcccuaauguuaccaacgggaauggauucuuugccacaauggcuugggcagugccaaagaacgacaaaaauaagaccgccacgaacccgcucacuaucgaaguccccuacauauguacagagggugaggaucagauuaccguguggggcuuccacagugacaaugaaacucagauggcuaaacuguauggggauuccaacccucagaaguuuacaucuagcgccaacggagugaccacgcacuacgucucccaaaucggcgguuucccaaaucagaccgaggacgggggacugccccagucaggccgcauuguuguggauuauaugguacagaagaguggcaaaacagggacuaucaccuaccaaagaggaauccucuuaccucagaagguguggugcgcgagcgguaggucuaaagucauuaagggcucccugccacuuauaggggaagcagacuguuugcaugagaaauauggaggccugaacaagucaaaacccuacuacacaggugagcacgccaaggcuaucgggaauugcccgauuugggugaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagccacggcgcccacgguguugcaguggcugccgauuugaaaaguacccaggaggcuauuaauaagaucacuaagaaccucaauucucuguccgaauuagaggucaaaaaccugcagcgacucagcggggccauggacgagcuucauaaugaaauccuggaguuggaugaaaagguggacgaccuaagagcagauacgauuucgucucaaaucgagcuggccguacuccuguccaacgaaggcauuauaaauucagaggacgagcaccuucuggcuuuggaaaggaaacucaagaaaaugcugggaccuagugcgguugagaucggcaacggguguuucgaaacaaagcauaagugcaaucagaccugcuuagaucggauugcagccggaacuuuugacgcuggugaguucagccugcccaccuuugauucccuaaacaucacagccgcaucucucaaugacgauggccuggacaaccacaccauccuuuuguauuacagcacugccgcuucaagucuggccgugacacucaugauugcaauauucgucguguauauggucucccgugauaacgugagcuguucuaucugccuguga

SEQ ID NO: 150316 - RNA, 1758 nt, Artificial Sequence; identical to SEQ ID NO: 149881
  derived and/or modified sequence opt3 from hemagglutinin__InfluenzaB__AIC73856

SEQ ID NO: 150317 - RNA, 1758 nt, Artificial Sequence; identical to SEQ ID NO: 149881
  derived and/or modified sequence opt3 from hemagglutinin__InfluenzaB__AIC73857

SEQ ID NO: 150318 - RNA, 1758 nt, Artificial Sequence; identical to SEQ ID NO: 149881
  derived and/or modified sequence opt3 from hemagglutinin__InfluenzaB__AIC73859

SEQ ID NO: 150319 - RNA, 1758 nt, Artificial Sequence
  derived and/or modified sequence opt3 from hemagglutinin__InfluenzaB__AIC73860
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaacccucagaaguuuacaucuagcgccaacggagugaccacgcacuacgucucccaaauuggcgguuucccaaaucagaccgaggacgggggacugccccagucaggccgcaucguuguggauuauaugguacagaaaaguggcaagacagggacuauuaccuaccaaagaggaauccucuuaccucagaaaguguggugcgcgagcgguaggucuaaggucaucaaaggcucccugccacuuauuggggaagcagacuguuugcaugagaaguauggaggccugaacaaaucaaagcccuacuacacaggugagcacgccaaggcuauagggaauugcccgaucugggugaaaacuccucuaaagcucgccaacggcaccaaauaucggcccccagcaaagcugcuuaaagaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaauaagauuacuaaaaaccucaauucucuguccgaauuagaggucaagaaccugcagcgacucagcggggccauggacgagcuucauaaugaaauccuggaguuggaugaaaaaguggacgaccuaagagcagauacgaugucgucucaaaucgagcuggccguacuccuguccaacgaaggcauuaucaauucagaggacgagcaccuucuggcuuuggaaaggaagcucaaaaagaugcugggaccuagugcgguugagauuggcaacggguguuucgaaacaaagcauaaaugcaaucagaccugcuuagaucggauagcagccggaacuuuugacgcuggugaguucagccugcccaccuuugauucccuaaacaucacagccgcaucucucaaugacgauggccuggacaaccacaccauucuuuuguauuacagcacugccgcuucaagucuggccgugacacucaugaucgcaaucuucgucguguauauggucucccgugauaacgugagcuguucuauuugccuguga

SEQ ID NO: 150320 - RNA, 1758 nt, Artificial Sequence
  derived and/or modified sequence opt3 from hemagglutinin__InfluenzaB__AIC73861
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaauacugagaacgccccagggggacccuauaagaucggcaccucaggcagcugcccuaauguuacaaacgggaauggauucuuugcaaccauggccugggcugugccgaaaaacgacaagaauaaaacggcaacuaacccacucacaauugaaguccccuacaucuguaccgagggugaggaucagauaacuguguggggcuuccacagugacaaugaaacacagauggccaagcuguauggggauuccaacccucagaaguuuaccucuagcgcuaacggagugacgauucacuacgucucccaaaucggcgguuucccaaaucagaccgaggacgggggacugccccagucaggccgcauuguuguggauuauaugguacagaaaaguggcaagacagggacuaucaccuaccaaagaggaauccucuuaccucagaaaguguggugcgccagcgguaggucuaaggucauuaaaggcucccugccacuuauaggggaagcggacuguuugcaugagaaguauggaggccugaacaaaucaaagcccuacuacacaggugagcacgcaaaggccaucgggaauugcccgauuugggugaaaacuccucuaaagcucgcuaacggcaccaaauaucggcccccagccaagcugcuuaaagaacgcggauuuuucggcgcaaucgcuggguuucuggagggagguugggaaggcaugauagccggguggcauggauacacaagccacggcgcgcacgguguugccguggcagcugauuugaagaguacccaggaggccauuaauaagaucacuaaaaaccucaauucucuguccgaauuagaggucaagaaccugcagcgacucagcggggcuauggacgagcuucauaaugaaauccuggaguuggaugaaaaaguggacgaccuaagagccgauacgauuucgucucaaaucgagcuggcaguacuccuguccaacgaaggcauuauaaauucagaggacgagcaccuucuggccuuggaaaggaagcucaaaaagaugcugggaccuagugcuguugagaucggcaacggguguuucgaaacaaagcauaaaugcaaucagaccugcuuagaucggauugcggcaggaacuuuugacgccggugaguucagccugcccaccuuugauucccuaaacaucacagcugccucucucaaugacgauggccuggacaaccacaccauccuuuuguauuacagcacugcagccucaagucuggcugugacacucaugauugccauauucgucguguauauggucucccgugauaacgugagcuguucuaucugccuguga

SEQ ID NO: 150321 - RNA, 1758 nt, Artificial Sequence; identical to SEQ ID NO: 150319
  derived and/or modified sequence opt3 from hemagglutinin__InfluenzaB__AIC73862

SEQ ID NO: 150322 - RNA, 1758 nt, Artificial Sequence; identical to SEQ ID NO: 150319
  derived and/or modified sequence opt3 from hemagglutinin__InfluenzaB__AIC73863

SEQ ID NO: 150323 - RNA, 1758 nt, Artificial Sequence; identical to SEQ ID NO: 150319
  derived and/or modified sequence opt3 from hemagglutinin__InfluenzaB__AIC73864

SEQ ID NO: 150324 - RNA, 1755 nt, Artificial Sequence
  derived and/or modified sequence opt3 from hemagglutinin__InfluenzaB__AIC73865
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagcgcgaggauggugggcucccacagagcggaagaaucguuguggacuacaugaugcaaaaacccggcaagacgggcaccauaguauaucagcgcgggguguuacugccucagaaagucuggugcgcuucuggacgguccaaggugauuaaagguucacuuccauugaucggcgaagccgauugucugcaugagaaguacgggggacuaaacaaaagcaagcccuacuauacaggcgaacacgcaaaggcuauugguaauugcccgaucuggguuaaaacuccucucaagcuggccaacgggaccaaauacaggcccccagcgaagcugcugaaagagcgaggcuuuuucggagccaucgcaggcuuuuuggaagggggaugggaagguaugauugcuggcuggcacggguauacaagucauggagcccacggcguggcugucgccgcagaccucaagucuacucaggaggccauaaauaagaucaccaaaaaccuuaauuccuuaagcgaacuggaggugaagaaccuccaaagacuuucgggugcuauggacgaacugcauaaugagauuuuggagcuagaugaaaaaguagacgaucugagggcggacacaaucucuucccagauagagcucgcaguucugcuuucaaacgaagggauuaucaauagugaggaugaacaccuguuggcccucgagcggaagcugaaaaagauguuaggcccuagcgcuguggacaucggaaacggcuguuucgagaccaagcacaaaugcaaucagacuugccuggaucguauugccgcagggacguuuaacgccggagaguucucccuacccacauuugacucucucaauaucaccgcugccagccugaacgaugacggucuugauaaucauacuauuuugcuguacuauucaaccgcagcgaguucccucgcugucacacugaugcuugccauauucaucguguacauggucagccgcgacaacgugucuuguucaauuugccuguga

SEQ ID NO: 150325 - RNA, 1758 nt, Artificial Sequence
  derived and/or modified sequence opt3 from hemagglutinin__InfluenzaB__AIC73867
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauugacgccgagaaugcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaauccucagaaguuuacaucuagcgccaacggagugaccacgcacuacgucucccaaauuggcgguuucccaaaccagaccgaggaugggggacugccccagucaggccgcaucguuguggacuauaugguacagaaaaguggcaagacagggacuauuaccuaccaaagaggaauccucuuaccucagaaaguguggugcgcgagcgguaggucuaaggucaucaaaggcucccugccacuuauuggggaagcagauuguuugcaugagaaguauggaggccugaauaaaucaaagcccuacuacacaggugagcacgccaaggcuauagggaacugcccgaucugggugaaaacuccucuaaagcucgccaauggcaccaaauaucggcccccagcaaagcugcuuaaagaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaacaagauuacuaaaaaucucaacucucuguccgaauuagaggucaagaaucugcagcgacucagcggggccauggaugagcuucauaacgaaauccuggaguuggacgaaaaaguggacgaucuaagagcagacacgaucucgucucaaauugagcuggccguacuccuguccaaugaaggcaucauuaacucagaggaugagcaccuucuggcuuuggaaaggaagcucaaaaagaugcugggaccuagugcgguugagauaggcaauggguguuucgaaacaaagcauaaaugcaaccagaccugcuuagaccggaucgcagccggaacuuuugaugcuggugaguucagccugcccaccuuugacucccuaaauauuacagccgcaucucucaacgaugacggccuggauaaucacaccauccuuuuguauuacagcacugccgcuucaagucuggccgugacacucaugaucgcaauuuucgucguguauauggucucccgugacaacgugagcuguucuauaugccuguga

SEQ ID NO: 150326 - RNA, 1758 nt, Artificial Sequence; identical to SEQ ID NO: 148903
  derived and/or modified sequence opt3 from hemagglutinin__InfluenzaB__AIC73868

SEQ ID NO: 150327 - RNA, 1758 nt, Artificial Sequence; identical to SEQ ID NO: 150319
  derived and/or modified sequence opt3 from hemagglutinin__InfluenzaB__AIC73869

SEQ ID NO: 150328 - RNA, 1758 nt, Artificial Sequence; identical to SEQ ID NO: 150319
  derived and/or modified sequence opt3 from hemagglutinin__InfluenzaB__AIC73870

SEQ ID NO: 150329 - RNA, 1758 nt, Artificial Sequence; identical to SEQ ID NO: 149881
  derived and/or modified sequence opt3 from hemagglutinin__InfluenzaB__AIC73871

SEQ ID NO: 150330 - RNA, 1755 nt, Artificial Sequence; identical to SEQ ID NO: 150305
  derived and/or modified sequence opt3 from hemagglutinin__InfluenzaB__AIC73872

SEQ ID NO: 150331 - RNA, 1755 nt, Artificial Sequence; identical to SEQ ID NO: 150145
  derived and/or modified sequence opt3 from hemagglutinin__InfluenzaB__AIC73873

SEQ ID NO: 150332 - RNA, 1755 nt, Artificial Sequence; identical to SEQ ID NO: 150305
  derived and/or modified sequence opt3 from hemagglutinin__InfluenzaB__AIC73874

SEQ ID NO: 150333 - RNA, 1755 nt, Artificial Sequence; identical to SEQ ID NO: 150324
  derived and/or modified sequence opt3 from hemagglutinin__InfluenzaB__AIC73875

SEQ ID NO: 150334 - RNA, 1755 nt, Artificial Sequence
  derived and/or modified sequence opt3 from hemagglutinin__InfluenzaB__AIC73876
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaagacaaggggcaaauuguguccggauugcuuaaacuguaccgaccuggauguugcgcuagggcggcccaugugcgugggaacgacuccuagcgcuaaggccuccauccuccaugaaguccgcccagugaccucuggcuguuuucccauuaugcacgaccgaacaaagauccgucaacuggcaaaucuucugagagguuaugagaacauaagguugucgacucagaauguaaucgaugccgaaaaagcuccugggggaccauaccggcucggcaccucaggcagcugccccaacgcaacaaguaaguccggguucuuugccaccauggcuugggccguuccuaaagacaauaacaagaaugcgacgaacccacugacuguggaggucccguauauuugugcagaaggagaggaucagaucacagugugggguuuccauucugacaauaaaacccagaugaagaaccuguacggcgauagcaauccccaaaaguuuacuuccucagccaacggggugacaacccacuaugucagucagauuggaggcuucccugaccagcgcgaggauggugggcucccacagagcggaagaaucguuguggacuacaugaugcaaaaacccggcaagacgggcaccauaguauaucagcgcgggguguuacugccucagaaagucuggugcgcuucuggacgguccaaggugauuaaagguucacuuccauugaucggcgaagccgauugucugcaugagaaguacgggggacuaaacaaaagcaagcccuacuauacaggcgaacacgcaaaggcuauugguaauugcccgaucuggguuaaaacuccucucaagcuggccaacgggaccaaauacaggcccccagcgaagcugcugaaagagcgaggcuuuuucggagccaucgcaggcuuuuuggaagggggaugggaagguaugauugcuggcuggcacggguauacaagucauggagcccacggcguggcugucgccgcagaccucaagucuacucaggaggccauaaauaagaucaccaaaaaccuuaauuccuuaagcgaacuggaggugaagaaccuccaaagacuuucgggugcuauggacgaacugcauaaugagauuuuggagcuagaugaaaaaguagacgaucugagggcggacacaaucucuucccagauagagcucgcaguucugcuuucaaacgaagggauuaucaauagugaggaugaacaccuguuggcccucgagcggaagcugaaaaagauguuaggcccuagcgcuguggacaucggaaacggcuguuucgagaccaagcacaaaugcaaucagacuugccugaaccguauugccgcagggacguuuaaugccggagaguucucccuacccacauuugauucucucaacaucaccgcugccagccugaaugacgauggucuugacaaccauacuauuuugcuguacuauucaaccgcagcgaguucccucgcugucacacugaugcuugccauauucaucguguacauggucagccgcgauaacgugucuuguucaauuugccuguga

SEQ ID NO: 150335 - RNA, 1755 nt, Artificial Sequence; identical to SEQ ID NO: 150324
  derived and/or modified sequence opt3 from hemagglutinin__InfluenzaB__AIC73877

SEQ ID NO: 150336 - RNA, 1755 nt, Artificial Sequence; identical to SEQ ID NO: 150324
  derived and/or modified sequence opt3 from hemagglutinin__InfluenzaB__AIC73878

SEQ ID NO: 150337 - RNA, 1755 nt, Artificial Sequence; identical to SEQ ID NO: 150324
  derived and/or modified sequence opt3 from hemagglutinin__InfluenzaB__AIC73879

SEQ ID NO: 150338 - RNA, 1755 nt, Artificial Sequence; identical to SEQ ID NO: 150324
  derived and/or modified sequence opt3 from hemagglutinin__InfluenzaB__AIC73880

SEQ ID NO: 150339 - RNA, 1755 nt, Artificial Sequence; identical to SEQ ID NO: 150324
  derived and/or modified sequence opt3 from hemagglutinin__InfluenzaB__AIC73881

SEQ ID NO: 150340 - RNA, 1755 nt, Artificial Sequence; identical to SEQ ID NO: 150324
  derived and/or modified sequence opt3 from hemagglutinin__InfluenzaB__AIC73882

SEQ ID NO: 150341 - RNA, 1755 nt, Artificial Sequence; identical to SEQ ID NO: 150145
  derived and/or modified sequence opt3 from hemagglutinin__InfluenzaB__AIC73883

SEQ ID NO: 150342 - RNA, 1755 nt, Artificial Sequence; identical to SEQ ID NO: 150324
  derived and/or modified sequence opt3 from hemagglutinin__InfluenzaB__AIC73884

SEQ ID NO: 150343 - RNA, 1758 nt, Artificial Sequence
  derived and/or modified sequence opt3 from hemagglutinin__InfluenzaB__AIC73885
auggaagccaucauugugcugcucauggucguuaccagcaacgcugacagaauaugcacaggcaucacuuccucuaauucaccccacgugguaaagacggcaacccagggggaagugaacgucacaggagugauuccucuuacuaccacaccaaccaaaagucauuucgccaaucugaaggguacugagacaaggggcaaauuguguccgaagugcuuaaacuguaccgaucuggacguugcgcuagggcggcccaaaugcacgggaaagaucccuagcgcucgcguguccauucuccacgaaguccgaccagugacuucuggcuguuuucccaucaugcaugaucguaccaagauaagacaacugccuaaucuucugagggguuacgagcacauccgguugucgacacauaacguaauuaaugccgaagacgcaccagggggacccuauaaaaucggcacuucaggcagcugcccuaacguuaccaaugggaacggauucuuugccacaauggcuugggcagugccaaagaaugauaaaaacaagaccgccacgaauccgcucacuauugagguccccuacaucuguacagagggugaagaccagauaaccguguggggcuuccacagugauaacgagacucagauggcuaaacuguauggggacuccaagccucagaaguuuacaucuagcgccaauggagugaccacgcacuacgucucccaaauuggcgguuucccaaaccagaccgaagaugggggacugccccagucaggccgcaucguuguggacuauaugguacagaaaaguggcaagacagggacuauuaccuaccaaagaggaauccucuuaccucagaaaguguggugcgcgagcgguaggucuaaggucaucaaaggcucccugccacuuauuggggaggcagauuguuugcaugagaaguauggaggccugaacaaaucaaagcccuacuacacaggugaacacgccaaggcuauagggaauugcccgaucugggugaaaacuccucuaaagcucgccaacggcaccaaauaucggcccccagcaaagcugcuuaaagagcgcggauuuuucggcgcuauugccggguuucuggaaggagguugggagggcaugaucgcgggguggcauggauacacaagccacggcgcccacgguguugcaguggcugccgacuugaagaguacccaggaagcuauaaauaagauuacuaaaaaccucaauucucuguccgaguuagaggucaagaaccugcagcgacucagcggggccauggaugaacuucauaaugagauccuggaauuggacgagaaaguggacgaucuaagagcagacacgaucucgucucaaauugaacuggccguacuccuguccaacgagggcaucauuaauucagaggaugaacaccuucuggcuuuggagaggaagcucaaaaagaugcugggaccuagugcgguugaaauaggcaacggguguuucgagacaaagcauaaaugcaaucagaccugcuuagaccggaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgugacaaugugagcuguucuauaugccuguga

SEQ ID NO: 150344 - RNA, 1758 nt, Artificial Sequence; identical to SEQ ID NO: 149881
  derived and/or modified sequence opt3 from hemagglutinin__InfluenzaB__AIC73886

SEQ ID NO: 150345 - RNA, 1758 nt, Artificial Sequence; identical to SEQ ID NO: 150325
  derived and/or modified sequence opt3 from hemagglutinin__InfluenzaB__AIC73887

SEQ ID NO: 150346 - RNA, 1755 nt, Artificial Sequence; identical to SEQ ID NO: 150145
  derived and/or modified sequence opt3 from hemagglutinin__InfluenzaB__AIC73888

SEQ ID NO: 150347 - RNA, 1755 nt, Artificial Sequence; identical to SEQ ID NO: 150305
  derived and/or modified sequence opt3 from hemagglutinin__InfluenzaB__AIC73889

SEQ ID NO: 150348 - RNA, 1755 nt, Artificial Sequence; identical to SEQ ID NO: 150305
  derived and/or modified sequence opt3 from hemagglutinin__InfluenzaB__AIC73890

SEQ ID NO: 150349 - RNA, 1758 nt, Artificial Sequence
  derived and/or modified sequence opt3 from hemagglutinin__InfluenzaB__AIC73892
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuagccuaaaacucgccaacggcaccaaguaucggccucccgcaaaacugcuuaaggaacgcggauuuuucggcgcuauugccggguuucuggagggagguugggaaggcaugaucgcgggguggcauggauacacaagucacggcgcccacgguguugcaguggcugccgacuugaagucuacccaggaggcuauaaauaaaauuacuaagaaccucaauucccugagcgaauuagaggucaaaaaccugcagcgacucucgggggccauggaugagcuucauaaugaaauccuggaguuggacgaaaagguggacgaucuaagagcagacacgaucucuucccaaauugagcuggccguacuccugucaaacgaaggcaucauuaauagugaggaugagcaccuucuggcuuuggaaaggaaacucaagaagaugcugggaccaagcgcgguugagauaggcaacggguguuucgaaacaaaacauaagugcaaucagaccugcuuagaccggaucgcagccggaacuuuugaugcuggugaguucucccugccuaccuuugacucucuaaacauuacagccgcaagccucaaugaugacggccuggauaaccacaccauccuuuuguauuacucaacugccgcuaguucccuggccgugacacucaugaucgcaauuuucgucguguauauggucagccgugacaaugugucuuguucaauaugccuguga

SEQ ID NO: 150350 - RNA, 1755 nt, Artificial Sequence; identical to SEQ ID NO: 150145
  derived and/or modified sequence opt3 from hemagglutinin__InfluenzaB__AIC73893

SEQ ID NO: 150351 - RNA, 1755 nt, Artificial Sequence; identical to SEQ ID NO: 150305
  derived and/or modified sequence opt3 from hemagglutinin__InfluenzaB__AIC73894

SEQ ID NO: 150352 - RNA, 1755 nt, Artificial Sequence; identical to SEQ ID NO: 150305
  derived and/or modified sequence opt3 from hemagglutinin__InfluenzaB__AIC73895

SEQ ID NO: 150353 - RNA, 1755 nt, Artificial Sequence; identical to SEQ ID NO: 150305
  derived and/or modified sequence opt3 from hemagglutinin__InfluenzaB__AIC73896

SEQ ID NO: 150354 - RNA, 1755 nt, Artificial Sequence; identical to SEQ ID NO: 150305
  derived and/or modified sequence opt3 from hemagglutinin__InfluenzaB__AIC73897

SEQ ID NO: 150355 - RNA, 1755 nt, Artificial Sequence; identical to SEQ ID NO: 150305
  derived and/or modified sequence opt3 from hemagglutinin__InfluenzaB__AIC73898

SEQ ID NO: 150356 - RNA, 1755 nt, Artificial Sequence; identical to SEQ ID NO: 150305
  derived and/or modified sequence opt3 from hemagglutinin__InfluenzaB__AIC73899

SEQ ID NO: 150357 - RNA, 1755 nt, Artificial Sequence; identical to SEQ ID NO: 150305
  derived and/or modified sequence opt3 from hemagglutinin__InfluenzaB__AIC73900

SEQ ID NO: 150358 - RNA, 1755 nt, Artificial Sequence; identical to SEQ ID NO: 150305
  derived and/or modified sequence opt3 from hemagglutinin__InfluenzaB__AIC73902

SEQ ID NO: 150359 - RNA, 1755 nt, Artificial Sequence
  derived and/or modified sequence opt3 from hemagglutinin__InfluenzaB__AIC73903
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaaugggaucaccacgcacuacgugagucagauaggagacuucccagaucagaccgaggacggcggucugccccaaagcgggagaauugucguugauuauaugaugcagaaaccuggaaagacaggcacuaucguguaccagaggggcguacucuuaccacagaaaguguggugcgcaucugggcgguccaaggucauuaaaggaucacugccccuuaucggugaagccgacuguuugcaugaggaauacggcgggcugaacaagagcaaaccguauuacaccggaaagcacgcuaaggccaucggcaauugcccuauuugggugaaaacaccccuaaagcucgcaaacgguacuaaauaucgcccuccagcuaagcugcuuaaagagcgaggguuuuucggcgccauagcgggauuucuggagggcgggugggaaggaaugaucgccgguuggcacggcuacaccagucauggggcacacggaguugcuguggccgcugacuugaagucuacacaagaggccauuaacaagaucaccaaaaaucucaacucccugagcgaauuagaggucaagaaucugcagagacucucgggcgcaauggaugaacuucauaacgagauacuggaguuggacgaaaaaguggaugaccuaagggccgauacuauuucuucccagaucgagcuggcuguacuccugucaaaugaagguaucauuaacagugaggacgaacaccuucuggcguuggagcggaagcucaaaaagaugcuggggcccagcgcaguugauaucggcaauggauguuucgagacgaagcacaaaugcaaccaaacaugcuuagaccguauugccgcuggcaccuuuaaugccggggaguucucccugccaacuuuugauucucuaaacauaaccgcagccagccucaaugacgauggacuggacaaccauacaauccuuuuguauuacucaaccgcugccaguucccuggcagugacucucaugcuggcgauuuucaucgucuauauggugagccgcgacaaugucucuuguucaaucugccuuuga

SEQ ID NO: 150360 - RNA, 1755 nt, Artificial Sequence
  derived and/or modified sequence opt3 from hemagglutinin__InfluenzaB__AIC73904
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaaucacgccuagcgcuaaagccuccauucuccaugaaguccgaccagugacuucuggcuguuuucccaucaugcacgaccguaccaagauaagacaacugccuaaucuucugagggguuaugagaagauccgguugucgacacagaacguaauugaugcagaaaaagccccagggggacccuaccgccucggcacuucaggcagcugcccuaaugcuaccaguaagaucggguucuuugcaacaauggccugggcuguuccaaaagacaacuauaagaaugccaccaacccgcagacgguggagguccccuacauuuguacugaaggagaggaucagaucacagugugggguuuccauuccgacaauaaaacccaaaugaagucucuguauggcgauagcaacccucagaaguuuacuuccucagcgaauggggugacaacccacuacgucagucagauaggagacuucccagaucagacggaggacggcggucugccccaaagcgggagaauuguuguggauuauaugaugcagaaaccuggaaagaccggcacaaucguauaccagaggggcgugcucuuaccacagaaagucuggugcgcaucugggcgguccaaggugauuaaaggaucacugccccuuaucggugaagccgacuguuugcaugaggaauacggcgggcugaacaagagcaaaccguauuacacuggaaagcacgcuaaggccaucggcaauugcccuauuuggguuaaaaccccucuaaagcucgcaaacgguacaaaauaucgcccacccgcuaagcugcuuaaagagcgaggguuuuucggcgccauagcgggauuucuggagggcgggugggaaggaaugaucgccgguuggcacggcuacacaagucauggggcacacggaguggcugucgccgcugacuugaagucuacccaagaggccauuaacaagaucacuaaaaaucucaacucccugagcgaauuagaggugaagaaucugcagagacucucgggcgcaauggaugaacuucauaacgagauacuggaguuggacgaaaaaguagaugaccuaagggccgauaccauuucuucccagaucgagcuggcuguucuccugucaaaugaagguaucauuaacagugaggacgaacaccuucuggcguuggagcggaagcucaaaaagaugcuggggcccagcgcaguggauaucggcaauggauguuucgagacuaagcacaaaugcaaccaaacgugcuuagaccguauugccgcuggcacauuuaaugccggggaguucucccugccaaccuuugauucucuaaacauaacugcagccagccucaaugacgauggacuggacaaccauaccauccuuuuguauuacucaacagcugccaguucccuggcagucacccucaugcuggcgauuuucaucguguauauggucagccgcgacaaugugucuuguucaaucugccuuuga

SEQ ID NO: 150361 - RNA, 1755 nt, Artificial Sequence; identical to SEQ ID NO: 150305
  derived and/or modified sequence opt3 from hemagglutinin__InfluenzaB__AIC73905

SEQ ID NO: 150362 - RNA, 1755 nt, Artificial Sequence; identical to SEQ ID NO: 150305
  derived and/or modified sequence opt3 from hemagglutinin__InfluenzaB__AIC73906

SEQ ID NO: 150363 - RNA, 1755 nt, Artificial Sequence; identical to SEQ ID NO: 150305
  derived and/or modified sequence opt3 from hemagglutinin__InfluenzaB__AIC73907

SEQ ID NO: 150364 - RNA, 1755 nt, Artificial Sequence; identical to SEQ ID NO: 150305
  derived and/or modified sequence opt3 from hemagglutinin__InfluenzaB__AIC73908

SEQ ID NO: 150365 - RNA, 1755 nt, Artificial Sequence; identical to SEQ ID NO: 150305
  derived and/or modified sequence opt3 from hemagglutinin__InfluenzaB__AIC73909

SEQ ID NO: 150366 - RNA, 1755 nt, Artificial Sequence; identical to SEQ ID NO: 150305
  derived and/or modified sequence opt3 from hemagglutinin__InfluenzaB__AIC73910

SEQ ID NO: 150367 - RNA, 1755 nt, Artificial Sequence; identical to SEQ ID NO: 150305
  derived and/or modified sequence opt3 from hemagglutinin__InfluenzaB__AIC73911

SEQ ID NO: 150368 - RNA, 1755 nt, Artificial Sequence; identical to SEQ ID NO: 150305
  derived and/or modified sequence opt3 from hemagglutinin__InfluenzaB__AIC73912

SEQ ID NO: 150369 - RNA, 1755 nt, Artificial Sequence; identical to SEQ ID NO: 150305
  derived and/or modified sequence opt3 from hemagglutinin__InfluenzaB__AIC73913

SEQ ID NO: 150370 - RNA, 1755 nt, Artificial Sequence; identical to SEQ ID NO: 150305
  derived and/or modified sequence opt3 from hemagglutinin__InfluenzaB__AIC73914

SEQ ID NO: 150371 - RNA, 1755 nt, Artificial Sequence; identical to SEQ ID NO: 150305
  derived and/or modified sequence opt3 from hemagglutinin__InfluenzaB__AIC73915

SEQ ID NO: 150372 - RNA, 1755 nt, Artificial Sequence; identical to SEQ ID NO: 150305
  derived and/or modified sequence opt3 from hemagglutinin__InfluenzaB__AIC73916

SEQ ID NO: 150373 - RNA, 1755 nt, Artificial Sequence; identical to SEQ ID NO: 150305
  derived and/or modified sequence opt3 from hemagglutinin__InfluenzaB__AIC73917

SEQ ID NO: 150374 - RNA, 1755 nt, Artificial Sequence; identical to SEQ ID NO: 150305
  derived and/or modified sequence opt3 from hemagglutinin__InfluenzaB__AIC73918

SEQ ID NO: 150375 - RNA, 1755 nt, Artificial Sequence; identical to SEQ ID NO: 150145
  derived and/or modified sequence opt3 from hemagglutinin__InfluenzaB__AIC73919

SEQ ID NO: 150376 - RNA, 1755 nt, Artificial Sequence; identical to SEQ ID NO: 150305
  derived and/or modified sequence opt3 from hemagglutinin__InfluenzaB__AIC73920

SEQ ID NO: 150377 - RNA, 1758 nt, Artificial Sequence; identical to SEQ ID NO: 149881
  derived and/or modified sequence opt3 from hemagglutinin__InfluenzaB__AIC73921

SEQ ID NO: 150378 - RNA, 1755 nt, Artificial Sequence; identical to SEQ ID NO: 150305
  derived and/or modified sequence opt3 from hemagglutinin__InfluenzaB__AIC73922

SEQ ID NO: 150379 - RNA, 1758 nt, Artificial Sequence; identical to SEQ ID NO: 148903
  derived and/or modified sequence opt3 from hemagglutinin__InfluenzaB__AIC73924

SEQ ID NO: 150380 - RNA, 1758 nt, Artificial Sequence
  derived and/or modified sequence opt3 from hemagglutinin__InfluenzaB__AIC73925
augaaggccaccaucgugcugcucauggucguuacaagcaacgcugacagaauuugcacuggcauaacguccucuaauucaccccacgugguaaaaaccgcaacacagggggaggugaacgucacuggagugaucccucuuaccacaaccccaacuaagagucauuucgccaaucugaaagguacagaaaccaggggcaaguuguguccgaaaugcuuaaacuguacggaucuggacguugcgcuagggcggcccaagugcacuggaaagauuccuagcgcucgcguguccauccuccacgagguccgaccagugaccucuggcuguuuucccauuaugcaugaucguacaaaaaucagacaacugccuaaucuucugagggguuacgaacacauacgguugucgacucauaacguaaucaaugccgaggacgcaccagggggacccuauaagauuggcaccucaggcagcugcccuaacguuacaaaugggaacggauucuuugccaccauggcuugggcagugccgaaaaaugauaagaacaaaacggccacuaauccacucacaaucgaaguccccuacauuuguaccgagggugaggaccagaucacuguguggggcuuccacagugauaacgaaacacagauggcuaagcuguauggggacuccaagccucagaaauuuaccucuagcgccaauggagugacgacccacuacgucucccaaauaggcgguuucccaaaccagacagaggaugggggacugccccagucaggccgcauuguuguggacuauaugguacagaagaguggcaaaacugggaccaucacauaccaaagagguauucucuuaccucagaagguguggugcgcgagcggaaggucuaaagucaucaagggcucccugccacuuaucggggaagcagauuguuugcaugagaaauauggaggccugaacaagucaaagcccuacuacacuggugagcacgccaaagcuauugggaauugcccgauaugggugaagaccccucuaaaacucgccaacggcacaaaguaucggcccccagcaaaacugcuuaaggaacgcggauuuuucggcgcuaucgccggguuucuggagggagguugggaaggcaugauugcgggguggcauggauacaccagccacggcgcccacgguguugcaguggcugccgacuugaagaguacucaggaggcuaucaauaaaauaacgaagaaccucaauucucuguccgaauuagaggucaaaaaccugcagcgacucagcggggccauggaugagcuucauaaugaaauucuggaguuggacgaaaagguggacgaucuaagagcagacacaaucucgucucaaaucgagcuggccguacuccuguccaacgaaggcauuaucaauucagaggaugagcaccuucuggcuuuggaaaggaaacucaagaagaugcugggaccuagugcgguugagauuggcaacggguguuucgaaaccaaacauaagugcaaucagacuugcuuagaccggauagcagccggaaccuuugaugcuggugaguucagccugcccacauuugacucccuaaacaucaccgccgcaucucucaaugaugacggccuggauaaccacacuauucuuuuguauuacagcacagccgcuucaagucuggccgugacgcucaugaucgcaaucuucgucguguauauggucucccgugacaaugugagcuguucuauuugccuguga

SEQ ID NO: 150381 - RNA, 1755 nt, Artificial Sequence; identical to SEQ ID NO: 150305
  derived and/or modified sequence opt3 from hemagglutinin__InfluenzaB__AIC73926

SEQ ID NO: 150382 - RNA, 1755 nt, Artificial Sequence; identical to SEQ ID NO: 148583
  derived and/or modified sequence opt3 from hemagglutinin__InfluenzaB__AIL94977

SEQ ID NO: 150383 - RNA, 1755 nt, Artificial Sequence; identical to SEQ ID NO: 148583
  derived and/or modified sequence opt3 from hemagglutinin__InfluenzaB__AIL94988

SEQ ID NO: 150384 - RNA, 1755 nt, Artificial Sequence
  derived and/or modified sequence opt3 from hemagglutinin__InfluenzaB__AIL94999
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaacauacgguugucgacucagaauguaaucgaugcagaaaaggccccagggggacccuaccgccucggcaccucaggcagcugcccuaacgcuacaaguaaaaccggguucuuugcaacgauggccugggcuguuccaaaggacaauuauaaaaacgccacuaauccgcugacaguggagguccccuacauuuguaccgaaggagaggaucagaucacugugugggguuuccauuccgacaacaagacacagaugaaaaaucuguauggcgauucuaacccucaaaaguuuaccagcuccgcgaauggggugacgacccacuacgucucacagauuggagacuucccagaucagacagaggacggcggucucccccagagugggagaaucguuguggauuauaugaugcaaaagccuggaaaaacuggcaccauaguauaccagaggggcguguuacugccacagaaggucuggugcgcaagcgggcggucuaaagugauuaagggaucccuucccuugaucggugaagccgacugucugcaugagaaauacggcgggcuaaacaagucaaaaccguauuacacaggagaacacgcuaaggccauuggcaacugcccuaucuggguuaagacuccccucaaacuggcaaaugguaccaaguaucgcccuccagcuaaacuucugaaggagcgaggguuuuucggcgccaucgcgggauuuuuggagggcgggugggaaggaaugauugccgguuggcacggcuacacaagccauggggcacacggaguggcugucgccgcugaccucaaaaguacccaggaggccauaaacaagaucacuaagaaucugaacucuuuauccgaacuggaggugaaaaaucuccaaagacuuagcggcgcaauggaugaacugcauaacgagauuuuggagcuagacgaaaagguagaugaccugagggccgauacgaucucgucucagauagagcucgcuguucugcuuuccaaugaagguauuaucaacucagaggacgaacaccuguuggcgcucgagcggaaacugaagaaaauguuagggcccagugcaguggauaucggcaauggauguuucgagacaaagcacaagugcaaccagaccugccuggaccguauugccgcuggcacuuuuaaugccggggaguucagccuaccaaccuuugauucccucaacaucacagcagccucucugaaugacgauggacuugacaaccauaccauuuugcuguauuacagcacugcugccucaagucucgcagucacacugaugcuugcgauauucaucguguauauggucucccgcgacaaugugagcuguucuauuugccuguga

SEQ ID NO: 150385 - RNA, 1755 nt, Artificial Sequence; identical to SEQ ID NO: 148583
  derived and/or modified sequence opt3 from hemagglutinin__InfluenzaB__AIL95010

SEQ ID NO: 150386 - RNA, 1755 nt, Artificial Sequence; identical to SEQ ID NO: 148836
  derived and/or modified sequence opt3 from hemagglutinin__InfluenzaB__AIL95021

SEQ ID NO: 150387 - RNA, 1758 nt, Artificial Sequence; identical to SEQ ID NO: 148664
  derived and/or modified sequence opt3 from hemagglutinin__InfluenzaB__AIL95032

SEQ ID NO: 150388 - RNA, 1755 nt, Artificial Sequence; identical to SEQ ID NO: 148836
  derived and/or modified sequence opt3 from hemagglutinin__InfluenzaB__AIL95043

SEQ ID NO: 150389 - RNA, 1758 nt, Artificial Sequence; identical to SEQ ID NO: 148710
  derived and/or modified sequence opt3 from hemagglutinin__InfluenzaB__AIL95054

SEQ ID NO: 150390 - RNA, 1758 nt, Artificial Sequence; identical to SEQ ID NO: 148664
  derived and/or modified sequence opt3 from hemagglutinin__InfluenzaB__AIL95065

SEQ ID NO: 150391 - RNA, 1758 nt, Artificial Sequence; identical to SEQ ID NO: 148661
  derived and/or modified sequence opt3 from hemagglutinin__InfluenzaB__AIL95076

SEQ ID NO: 150392 - RNA, 1758 nt, Artificial Sequence; identical to SEQ ID NO: 148664
  derived and/or modified sequence opt3 from hemagglutinin__InfluenzaB__AIL95087

SEQ ID NO: 150393 - RNA, 1755 nt, Artificial Sequence; identical to SEQ ID NO: 148836
  derived and/or modified sequence opt3 from hemagglutinin__InfluenzaB__AIL95098

SEQ ID NO: 150394 - RNA, 1758 nt, Artificial Sequence; identical to SEQ ID NO: 150175
  derived and/or modified sequence opt3 from hemagglutinin__InfluenzaB__AIL95109

SEQ ID NO: 150395 - RNA, 1758 nt, Artificial Sequence
  derived and/or modified sequence opt3 from hemagglutinin__InfluenzaB__AIL95120
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgagaacgcaccagggggacccuauaagaucggcacuucaggcagcugcccuaauguuaccaacgggaauggauucuuugccacaauggcuugggcagugccgaaaaacgacaagaauaaaaccgccacgaacccacucacuauugaaguccccuacaucuguacagagggugaggaucagauaaccguguggggcuuccacagugacaaugaaacucagauggcuaagcuguauggggauuccaagccucagaaauuuacaucuagcgccaacggagugaccacgcacuacgucucccaaauuggcgguuucccaaaccagaccgaggacgggggacugccccagucaggccgcaucguuguggauuauaugguacagaagaguggcaaaacagggacuauuaccuaccaaagaggaauccucuuaccucagaagguguggugcgcgagcgguaggucuaaagucaucaagggcucccugccacuuauuggggaagcagacuguuugcaugagaaauauggaggccugaauaagucaaagcccuacuacacaggugagcacgccaaagcuauagggaacugcccgaucugggugaagacuccucuaaaacucgccaauggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgauuugaagaguacccaggaggcuauaaacaaaauuacuaagaaucucaacucucuguccgaauuagaggucaaaaaucugcagcgacucagcggggccauggacgagcuucauaacgaaauccuggaguuggaugaaaagguggacgaccuaagagcagauacgaucucgucucaaauugagcuggccguacuccuguccaaugaaggcaucauuaacucagaggacgagcaccuucuggcuuuggaaaggaaacucaagaagaugcugggaccuagugcgguugagauaggcaauggguguuucgaaacaaaacauaagugcaaccagaccugcuuagauaaaaucgcagccggaacuuuugacgcuggugaguucagccugcccaccuuugauucccuaaauauuacagccgcaucucucaacgacgauggccuggacaaucacaccauccuuuuguauuacagcacugccgcuucaagucuggccgugacacucaugaucgcaauuuucgucguguauauggucucccgggauaacgugagcuguucuauaugccuguga

SEQ ID NO: 150396 - RNA, 1755 nt, Artificial Sequence; identical to SEQ ID NO: 150305
  derived and/or modified sequence opt3 from hemagglutinin__InfluenzaB__AKA54644

SEQ ID NO: 150397 - RNA, 1755 nt, Artificial Sequence
  derived and/or modified sequence opt3 from hemagglutinin__InfluenzaB__AKA54645
augaaggccaucaccgugcugcucauggucguuacaagcaacgcugacagaauuugcacuggcauaacguccucuaauucaccccacgugguaaaaaccgcaacacagggggaagugaacgucacuggagugaucccucuuaccacaaccccaacuaagaguuacuucgccaaucugaaagguacaaggacccggggcaaguuguguccggauugcuuaaacuguacggaccuggauguugcgcuagggcgccccaugugcgugggaacuaccccuagcgcuaaagccuccauucuccaugaaguccgaccagugacaucuggcuguuuucccaucaugcacgaccguacuaagauuagacaacugccuaaucuucugagggguuaugagaagauccgguugucgacccagaacguaauagaugcagaaaaagccccagggggacccuaccgccucggcacaucaggcagcugcccuaaugcuaccaguaagaucggguucuuugcaacgauggccugggcuguuccaaaagacaacuauaagaaugccacuaacccgcugacaguggagguccccuacauuuguaccgaaggagaggaucagaucacugugugggguuuccauuccgacaauaaaacacagaugaagucucuguauggcgauagcaacccucaaaaguuuaccuccucagcggacggggugacgacccacuacgucagucagauuggagauuucccagaccagacagaggauggcggucucccccagagcgggagaaucguuguggacuauaugaugcaaaaaccuggaaagacuggcaccauaguauaccagaggggcguguuacugccacagaaagucuggugcgcaucugggcgguccaaggugauuaaaggaucacuucccuugaucggugaagccgacugucugcaugaggaauacggcgggcuaaauaagagcaaaccguauuacacaggaaagcacgcuaaggccauuggcaacugcccuaucuggguuaaaacuccccucaagcuggcaaaugguaccaaauaucgcccuccagcuaagcugcugaaagagcgaggguuuuucggcgccaucgcgggauuuuuggagggcgggugggaaggaaugauugccgguuggcacggcuacacaagucauggggcacacggaguggcugucgccgcugaucucaagucuacccaggaggccauaaacaagaucacuaaaaaccuuaauuccuuaagcgaacuggaggugaagaaccuccaaagacuuucgggcgcaauggacgaacugcauaaugagauuuuggagcuagaugaaaaaguagacgaucugagggccgacacgaucucuucccagauagagcucgcuguucugcuuucaaacgaagguauuaucaauagugaggaugaacaccuguuggcgcucgagcggaagcugaaaaagauguuagggcccagcgcaguggacaucggcaacggauguuucgagacaaagcacaaaugcaaucagaccugccuggaucguauugccgcuggcacuuuuaacgccggggaguucucccuaccaaccuuugacucucucaauaucacagcagccagccugaacgaugacggacuugacaaucauaccauuuugcuguauuacucaacugcugccaguucccucgcagucacacugaugcuugcgauauucaucguguauauggucagccgcgauaacgugucuuguucaauuugccuguga

SEQ ID NO: 150398 - RNA, 1755 nt, Artificial Sequence; identical to SEQ ID NO: 150305
  derived and/or modified sequence opt3 from hemagglutinin__InfluenzaB__AKA54646

SEQ ID NO: 150399 - RNA, 1755 nt, Artificial Sequence; identical to SEQ ID NO: 150305
  derived and/or modified sequence opt3 from hemagglutinin__InfluenzaB__AKA54647

SEQ ID NO: 150400 - RNA, 1758 nt, Artificial Sequence; identical to SEQ ID NO: 148903
  derived and/or modified sequence opt3 from hemagglutinin__InfluenzaB__AKA54648

SEQ ID NO: 150401 - RNA, 1755 nt, Artificial Sequence
  derived and/or modified sequence opt3 from hemagglutinin__InfluenzaB__AKA54649
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaauacaaccaguaagauuggguucuuugcuacgauggcaugggccguuccaaaagacaacuauaagaaugcuacuaacccgcugacaguggagguccccuacaucuguaccgaaggagaggaucagauuacugugugggguuuccauuccgacaauaaaacacagaugaagucucuguauggcgauagcaacccucaaaaguuuaccuccucagccaauggggugacgacccacuacgucagucagaucggagacuucccagaucagacagaggacggcggucucccccagagcgggagaauaguuguggauuauaugaugcaaaaaccuggaaagacuggcaccauuguauaccagaggggcguguuacugccacagaaagucuggugcgcgucugggcgguccaaggugaucaaaggaucacuucccuugauuggugaagcagacugucugcaugaggaauacggcgggcuaaacaagagcaaaccguauuacacaggaaagcacgccaaggcuaucggcaauugcccuaucuggguuaaaacuccccucaagcuggccaacgguaccaaauaucgcccuccagcaaaacuucugaaggagcgaggguuuuucggcgcuauugccggauuuuuggagggcgggugggaaggaaugauagcggguuggcacggcuacacaagucauggggcccacggaguggcagucgcugccgaccucaagucuacccaggaggcuaucaacaagauuacuaaaaaucugaacuccuuaagcgaacuggaggugaagaaucuccaaagacuuucgggcgccauggaugaacugcauaacgagaucuuggagcuagacgaaaaaguagaugaccugagggcagauacgauaucuucccagauugagcucgccguucugcuuucaaaugaagguaucaucaacagugaggacgaacaccuguuggcucucgagcggaagcugaaaaagauguuagggcccagcgcgguggauauuggcaauggauguuucgagacaaagcacaaaugcaaccagaccugccuggaccguaucgcagccggcacuuuuaaugcuggggaguucucccuaccaaccuuugauucucucaacauuacagccgcaagccugaaugacgauggacuugacaaccauaccauauugcuguauuacucaacugccgcuaguucccucgccgucacacugaugcuugcaaucuucauuguguauauggucagccgcgacaaugugucuuguucaaucugccuguga

SEQ ID NO: 150402 - RNA, 1755 nt, Artificial Sequence; identical to SEQ ID NO: 150305
  derived and/or modified sequence opt3 from hemagglutinin__InfluenzaB__AKU40581

SEQ ID NO: 150403 - RNA, 1755 nt, Artificial Sequence; identical to SEQ ID NO: 150305
  derived and/or modified sequence opt3 from hemagglutinin__InfluenzaB__AKU40592

SEQ ID NO: 150404 - RNA, 1755 nt, Artificial Sequence; identical to SEQ ID NO: 150145
  derived and/or modified sequence opt3 from hemagglutinin__InfluenzaB__AKU40603

SEQ ID NO: 150405 - RNA, 1755 nt, Artificial Sequence; identical to SEQ ID NO: 150305
  derived and/or modified sequence opt3 from hemagglutinin__InfluenzaB__AKU40614

SEQ ID NO: 150406 - RNA, 1755 nt, Artificial Sequence; identical to SEQ ID NO: 150145
  derived and/or modified sequence opt3 from hemagglutinin__InfluenzaB__AKU40625

SEQ ID NO: 150407 - RNA, 1755 nt, Artificial Sequence
  derived and/or modified sequence opt3 from hemagglutinin__InfluenzaB__AKU40636
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccagccaagaguuacuucgcgaaucugaaagguaccaggacucggggcaaguuguguccggauugcuuaaacuguacagaccuggauguugcucuagggcgccccaugugcgugggaaccacgccuagcgccaaagcauccauccuccaugaaguccgaccagugacuucuggcuguuuucccauuaugcacgaccguaccaagaucagacaacugccuaaucuucugagggguuaugagaacauacgguugucgacaaagaauguaaucgaugccgaaaaagcuccagggggacccuaccgccucggcacuucaggcagcugcccuaacgcaaccaguaagauuggguucuuugccacaauggcuugggccguuccaaaagacaauuauaagaacgcgaccaauccgcugacgguggagguccccuacaucuguaaagaaggagaggaucagauuacugugugggguuuccauuccgacaacaagacacagaugaagaaucuguauggcgauucuaacccucagaaauuuaccagcuccgcaaauggggugacuacacacuacgucucacaaaucggagacuucccagaucagaccgaggacggcggucucccccagagugggagaauaguuguggauuauaugaugcagaagccuggaaaaacgggcaccauuguauaccaaaggggcguguuacugccacagaaggucuggugcgccagcgggcggucuaaagugaucaagggaucccuucccuugauuggugaagcugacugucugcaugaggaauacggcgggcuaaacaaaucaaagccguauuacacaggaaagcacgccaaagcaaucggcaacugcccuaucuggguuaagacuccccucaaacuggcuaaugguaccaaguaucgcccuccagccaaacuucugaaggagcgaggguuuuucggcgcgauugccggauuuuuggagggcgggugggaaggaaugauagcagguuggcacggcuacacaagccauggggcucacggaguggccgucgcugccgaccucaagaguacucaggaggcaaucaacaaaauuaccaagaaucugaacucuuuauccgaacuggaggugaaaaaucuccagagacuuagcggcgccauggaugaacugcauaacgagaucuuggagcuagacgaaaagguagaugaccugagggcugauacaauaucgucucaaauugagcucgcgguucugcuuuccaaugaagguaucaucaacucagaggacgaacaccuguuggcacucgagcggaaacugaagaagauguuagggcccagugccguggauauuggcaauggauguuucgagaccaaacacaagugcaaccagacuugccuggaccguaucgcugccggcacguuuaaugcaggggaguucagccuaccaacauuugauucccucaacauuaccgccgcuucucugaaugacgauggacuugacaaccauacuauauugcuguauuacagcaccgccgcaucaagucucgcggucacacugaugcuugcuaucuucauuguguauauggucucccgcgacaaugugagcuguucuaucugccuguga

SEQ ID NO: 150408 - RNA, 1755 nt, Artificial Sequence
  derived and/or modified sequence opt3 from hemagglutinin__InfluenzaB__AKU40647
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagauccccuacauuuguacagaaggagaggaucagaucaccgucugggguuuccauuccgacaauaaaacucaaaugaagucucuguauggcgauagcaacccucagaaguuuacauccucagcgaauggggugaccacgcacuacgugagucagauaggagacuucccagaucagaccgaggacggcggucugccccaaagcgggagaauugucguugauuauaugaugcagaaaccuggaaagacaggcacuaucguguaccagaggggcguacucuuaccacagaaaguguggugcgcaucugggcgguccaaggucauuaaaggaucacugccccuuaucggugaagccgacuguuugcaugaggaauacggcgggcugaacaagagcaaaccguauuacaccggaaagcacgcuaaggccaucggcaauugcccuauuugggugaaaacaccccuaaagcucgcaaacgguacuaaauaucgcccuccagcuaagcugcuuaaagagcgaggguuuuucggcgccauagcgggauuucuggagggcgggugggaaggaaugaucgccgguuggcacggcuacaccagucauggggcacacggaguugcuguggccgcugacuugaagucuacacaagaggccauuaacaagaucaccaaaaaucucaacucccugagcgaauuagaggucaagaaucugcagagacucucgggcgcaauggaugaacuucauaacgagauacuggaguuggacgaaaaaguggaugaccuaagggccgauacuauuucuucccagaucgagcuggcuguacuccugucaaaugaagguaucauuaacagugaggacgaacaccuucuggcguuggagcggaagcucaaaaagaugcuggggcccagcgcaguugauaucggcaauggauguuucgagacgaagcacaaaugcaaccaaacaugcuuagaccguauugccgcuggcaccuuuaaugccggggaguucucccugccaacuuuugauucucuaaacauaaccgcagccagccucaaugacgauggacuggacaaccauacaauccuuuuguauuacucaaccgcugccaguucccuggcagugacucucaugcuggcgauuuucaucgucuauauggugagccgcgacaaugucucuuguucaaucugccuuuga

SEQ ID NO: 150409 - RNA, 1755 nt, Artificial Sequence; identical to SEQ ID NO: 150305
  derived and/or modified sequence opt3 from hemagglutinin__InfluenzaB__AKU40658

SEQ ID NO: 150410 - RNA, 1755 nt, Artificial Sequence; identical to SEQ ID NO: 150305
  derived and/or modified sequence opt3 from hemagglutinin__InfluenzaB__AKU40669

SEQ ID NO: 150411 - RNA, 1755 nt, Artificial Sequence; identical to SEQ ID NO: 150305
  derived and/or modified sequence opt3 from hemagglutinin__InfluenzaB__AKU40680

SEQ ID NO: 150412 - RNA, 1755 nt, Artificial Sequence
  derived and/or modified sequence opt3 from hemagglutinin__InfluenzaB__AKU40691
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaguuccauaacgaaauccuugagcuggacgaaaaaguagaugacuugagggccgauacuauaucuucccagauugagcuagcuguucugcucucaaaugaagguaucaucaacagugaggacgaacaucugcuugcgcuggagcggaaguugaaaaagaugcucgggcccagcgcaguggauauuggcaauggauguuuugagacgaagcacaaaugcaaccaaacaugccuggaccguaucgccgcuggcaccuucaaugccggggaauuuuccuuaccaacuuucgauucucugaacauuaccgcagccagccuaaaugacgauggacucgacaaccacacaauacugcuuuauuacucaaccgcugccaguuccuuggcagucacucugaugcucgcgaucuucauuguguauauggucagccgcgacaaugugucuuguucaaucugccuguga

SEQ ID NO: 150413 - RNA, 1755 nt, Artificial Sequence; identical to SEQ ID NO: 150305
  derived and/or modified sequence opt3 from hemagglutinin__InfluenzaB__AKU40702

SEQ ID NO: 150414 - RNA, 1755 nt, Artificial Sequence; identical to SEQ ID NO: 150305
  derived and/or modified sequence opt3 from hemagglutinin__InfluenzaB__AKU40713

SEQ ID NO: 150415 - RNA, 1755 nt, Artificial Sequence; identical to SEQ ID NO: 150145
  derived and/or modified sequence opt3 from hemagglutinin__InfluenzaB__AKU40724

SEQ ID NO: 150416 - RNA, 1755 nt, Artificial Sequence; identical to SEQ ID NO: 150408
  derived and/or modified sequence opt3 from hemagglutinin__InfluenzaB__AKU40735

SEQ ID NO: 150417 - RNA, 1755 nt, Artificial Sequence; identical to SEQ ID NO: 150305
  derived and/or modified sequence opt3 from hemagglutinin__InfluenzaB__AKU40746

SEQ ID NO: 150418 - RNA, 1755 nt, Artificial Sequence; identical to SEQ ID NO: 150305
  derived and/or modified sequence opt3 from hemagglutinin__InfluenzaB__AKU40757

SEQ ID NO: 150419 - RNA, 1755 nt, Artificial Sequence; identical to SEQ ID NO: 150305
  derived and/or modified sequence opt3 from hemagglutinin__InfluenzaB__AKU40768

SEQ ID NO: 150420 - RNA, 1755 nt, Artificial Sequence; identical to SEQ ID NO: 150305
  derived and/or modified sequence opt3 from hemagglutinin__InfluenzaB__AKU40779

SEQ ID NO: 150421 - RNA, 1755 nt, Artificial Sequence; identical to SEQ ID NO: 150145
  derived and/or modified sequence opt3 from hemagglutinin__InfluenzaB__AKU40790

SEQ ID NO: 150422 - RNA, 1755 nt, Artificial Sequence; identical to SEQ ID NO: 150305
  derived and/or modified sequence opt3 from hemagglutinin__InfluenzaB__AKU40801

SEQ ID NO: 150423 - RNA, 1755 nt, Artificial Sequence
  derived and/or modified sequence opt3 from hemagglutinin__InfluenzaB__AKU40812
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacucacauacaauacuuuuguauuacaguaccgcugccuccagccuggcagucacucucaugcuggcgaucuucauuguguauauggucucucgcgacaacgugucauguaguaucugccuuuga

SEQ ID NO: 150424 - RNA, 1755 nt, Artificial Sequence; identical to SEQ ID NO: 150305
  derived and/or modified sequence opt3 from hemagglutinin__InfluenzaB__AKU40823

SEQ ID NO: 150425 - RNA, 1755 nt, Artificial Sequence; identical to SEQ ID NO: 150305
  derived and/or modified sequence opt3 from hemagglutinin__InfluenzaB__AKU40834

SEQ ID NO: 150426 - RNA, 1755 nt, Artificial Sequence; identical to SEQ ID NO: 150305
  derived and/or modified sequence opt3 from hemagglutinin__InfluenzaB__AKU40845

SEQ ID NO: 150427 - RNA, 1755 nt, Artificial Sequence; identical to SEQ ID NO: 150305
  derived and/or modified sequence opt3 from hemagglutinin__InfluenzaB__AKU40856

SEQ ID NO: 150428 - RNA, 1755 nt, Artificial Sequence; identical to SEQ ID NO: 150305
  derived and/or modified sequence opt3 from hemagglutinin__InfluenzaB__AKU40867

SEQ ID NO: 150429 - RNA, 1755 nt, Artificial Sequence; identical to SEQ ID NO: 150305
  derived and/or modified sequence opt3 from hemagglutinin__InfluenzaB__AKU40878

SEQ ID NO: 150430 - RNA, 1758 nt, Artificial Sequence
  derived and/or modified sequence opt3 from hemagglutinin__InfluenzaB__AKU40889
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacguuaccaaugggaacggauucuuugccacaauggcuugggcagugccgaaaaaugauaagaacaaaaccgccacgaauccacucacuacagaaguccccuacauuuguaccgagggugaggaccagaucacuguguggggcuuccacagugauaacgaaacacagauggcuaagcuguauggggacuccaagccucagaaauuuaccucuagcgccaauggagugacgacccacuacgucucccaaauaggcgguuucccaaaccagacagaggaugggggacugccccagucaggccgcauuguuguggacuauaugguacagaagaguggcaaaacugggaccaucacauaccaaagagguauucucuuaccucagaagguguggugcgcgagcggaaggucuaaagucaucaagggcucccugccacuuaucggggaagcagauuguuugcaugagaaauauggaggccugaacaagucaaagcccuacuacacuggugagcacgccaaagcuauugggaauugcccgauaugggugaagaccccucuaaaacucgccaacggcacaaaguaucggcccccagcaaaacugcuuaaggaacgcggauuuuucggcgcuaucgccggguuucuggagggagguugggaaggcaugauugcgggguggcauggauacaccagccacggcgcccacgguguugcaguggcugccgacuugaagaguacucaggaggcuaucaauaaaauaacgaagaaccucaauucucuguccgaauuagaggucaaaaaccugcagcgacucagcggggccauggaugagcuucauaaugaaauucuggaguuggacgaaaagguggacgaucuaagagcagacacaaucucgucucaaaucgagcuggccguacuccuguccaacgaaggcauuaucaauucagaggaugagcaccuucuggcuuuggaaaggaaacucaagaagaugcugggaccuagugcgguugagauuggcaacggguguuucgaaaccaaacauaagugcaaucagacuugcuuagaccggauagcagccggaaccuuugaugcuggugaguucagccugcccacauuugacucccuaaacaucaccgccgcaucucucaaugaugacggccuggauaaccacacuauucuuuuguauuacagcacagccgcuucaagucuggccgugacgcucaugaucgcaaucuucgucguguauauggucucccgugacaaugugagcuguucuauuugccuguga

SEQ ID NO: 150431 - RNA, 1755 nt, Artificial Sequence; identical to SEQ ID NO: 150305
  derived and/or modified sequence opt3 from hemagglutinin__InfluenzaB__AKU40900

SEQ ID NO: 150432 - RNA, 1755 nt, Artificial Sequence; identical to SEQ ID NO: 150145
  derived and/or modified sequence opt3 from hemagglutinin__InfluenzaB__AKU40911

SEQ ID NO: 150433 - RNA, 1755 nt, Artificial Sequence
  derived and/or modified sequence opt3 from hemagglutinin__InfluenzaB__AKU40922
augaaggccaucauugugcugcucauggucguuaccagcaacgcugacagaauaugcacaggcaucacuuccucuaauucaccccacgugguaaaaacggugacccagggggaagucaacgugacaggaguuauuccucuuacuaccacaccaaccaagaguuacuucgcaaaucugaaagguacuaggacacggggcaaguuguguccggauugcuuaaacuguaccgaccuggauguggcccuagggcgccccaugugcgucggaacgacuccuagcgcgaaggcuuccauccuccaugaagugcgaccaguaaccucuggcuguuuucccauuaugcacgaccguacaaaaaucagacaacugccuaaucuucugagggguuaugagaagauacgguugucgacucagaacguuaucgaugccgaaaaagcaccagggggacccuaccgccucggcaccucaggcagcugcccuaaugccacaaguaagauuggguucuuugcuaccauggcaugggccgugccaaaagacaacuauaagaaugcuacgaacccgcagacugucgaggugcccuacaucuguacagaaggagaggaucagauuaccgugugggguuuccauuccgacaauaaaacucaaaugaagucucuguauggcgauagcaacccucagaaguuuacauccucagccaauggggucaccacgcacuacguuagucagaucggagacuucccagaucagaccgaggacggcggucugccccaaagcgggagaauagugguagauuauaugaugcagaaaccuggaaagacaggcacuauuguguaccagaggggcguccucuuaccacagaaaguguggugcgcgucugggcgguccaagguuaucaaaggaucacugccccuuauuggugaagcagacuguuugcaugaggaauacggcgggcugaacaagagcaaaccguauuacaccggaaagcacgccaaggcuaucggcaauugcccuaucugggugaaaacaccccuaaagcucgccaacgguacuaaauaucgcccuccagcaaagcugcuuaaagagcgaggguuuuucggcgcuauugccggauuucuggagggcgggugggaaggaaugauagcggguuggcacggcuacaccagucauggggcccacggagucgcaguggcugccgacuugaagucuacacaagaggcuaucaacaagauuaccaaaaaucucaacucccugagcgaauuagagguaaagaaucugcagagacucucgggcgccauggaugaacuucauaacgagauccuggaguuggacgaaaaaguugaugaccuaagggcagauacuauaucuucccagauugagcuggccgugcuccugucaaaugaagguaucaucaacagugaggacgaacaccuucuggcuuuggagcggaagcucaaaaagaugcuggggcccagcgcggucgauauuggcaauggauguuucgagacgaagcacaaaugcaaccaaacaugcuuagaccguaucgcagccggcaccuuuaaugcuggggaguucucccugccaacuuuugauucucuaaacauuaccgccgcaagccucaaugacgauggacuggacaaccauacaauacuuuuguauuacucaaccgccgcuaguucccuggccgugacucucaugcuggcaaucuucauugucuauauggugagccgcgacaauguuucuuguucaaucugccuuuga

SEQ ID NO: 150434 - RNA, 1755 nt, Artificial Sequence; identical to SEQ ID NO: 150408
  derived and/or modified sequence opt3 from hemagglutinin__InfluenzaB__AKU40933

SEQ ID NO: 150435 - RNA, 1755 nt, Artificial Sequence; identical to SEQ ID NO: 150305
  derived and/or modified sequence opt3 from hemagglutinin__InfluenzaB__AKU40944

SEQ ID NO: 150436 - RNA, 1755 nt, Artificial Sequence; identical to SEQ ID NO: 150305
  derived and/or modified sequence opt3 from hemagglutinin__InfluenzaB__AKU40955

SEQ ID NO: 150437 - RNA, 1755 nt, Artificial Sequence; identical to SEQ ID NO: 150305
  derived and/or modified sequence opt3 from hemagglutinin__InfluenzaB__AKU40966

SEQ ID NO: 150438 - RNA, 1755 nt, Artificial Sequence; identical to SEQ ID NO: 150305
  derived and/or modified sequence opt3 from hemagglutinin__InfluenzaB__AKU40977

SEQ ID NO: 150439 - RNA, 1755 nt, Artificial Sequence; identical to SEQ ID NO: 150305
  derived and/or modified sequence opt3 from hemagglutinin__InfluenzaB__AKU40987

SEQ ID NO: 150440 - RNA, 1755 nt, Artificial Sequence; identical to SEQ ID NO: 150305
  derived and/or modified sequence opt3 from hemagglutinin__InfluenzaB__AKU40998

SEQ ID NO: 150441 - RNA, 1755 nt, Artificial Sequence; identical to SEQ ID NO: 150305
  derived and/or modified sequence opt3 from hemagglutinin__InfluenzaB__AKU41009

SEQ ID NO: 150442 - RNA, 1755 nt, Artificial Sequence; identical to SEQ ID NO: 150305
  derived and/or modified sequence opt3 from hemagglutinin__InfluenzaB__AKU41020

SEQ ID NO: 150443 - RNA, 1755 nt, Artificial Sequence; identical to SEQ ID NO: 150305
  derived and/or modified sequence opt3 from hemagglutinin__InfluenzaB__ALA08485

SEQ ID NO: 150444 - RNA, 1755 nt, Artificial Sequence; identical to SEQ ID NO: 150305
  derived and/or modified sequence opt3 from hemagglutinin__InfluenzaB__ALA08486

SEQ ID NO: 150445 - RNA, 1755 nt, Artificial Sequence; identical to SEQ ID NO: 150305
  derived and/or modified sequence opt3 from hemagglutinin__InfluenzaB__ALA08487

SEQ ID NO: 150446 - RNA, 1755 nt, Artificial Sequence; identical to SEQ ID NO: 150305
  derived and/or modified sequence opt3 from hemagglutinin__InfluenzaB__ALA08564

SEQ ID NO: 150447 - RNA, 1755 nt, Artificial Sequence; identical to SEQ ID NO: 150305
  derived and/or modified sequence opt3 from hemagglutinin__InfluenzaB__ALA08565

SEQ ID NO: 150448 - RNA, 1755 nt, Artificial Sequence; identical to SEQ ID NO: 150305
  derived and/or modified sequence opt3 from hemagglutinin__InfluenzaB__ALA08566

SEQ ID NO: 150449 - RNA, 1755 nt, Artificial Sequence; identical to SEQ ID NO: 150305
  derived and/or modified sequence opt3 from hemagglutinin__InfluenzaB__ALA08567

SEQ ID NO: 150450 - RNA, 1755 nt, Artificial Sequence; identical to SEQ ID NO: 150305
  derived and/or modified sequence opt3 from hemagglutinin__InfluenzaB__ALA08568

SEQ ID NO: 150451 - RNA, 1755 nt, Artificial Sequence; identical to SEQ ID NO: 150305
  derived and/or modified sequence opt3 from hemagglutinin__InfluenzaB__ALA08569

SEQ ID NO: 150452 - RNA, 1758 nt, Artificial Sequence
  derived and/or modified sequence opt3 from hemagglutinin__InfluenzaB__ALA08689
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugccccaacuguaccgauuuagacguugcgcuggggcggccuaagugcacgggaaagaucccaagcgcucgcguguccauucuacacgagguccgacccgugacuucuggcuguuuuccuaucaugcaugaucguaccaaaauaagacaacucccaaaucugcuuagggguuacgaacacauccggcugucgacacauaacguaauuaaugccgagaacgcacccgggggaccuuauaagaucggcacuucaggcagcugcccaaauguuaccaacgggaauggauucuuugccacaauggcuugggcagugccgaaaaacgacaagaauaaaaccgccacgaaccccuugacuauugaagucccuuacaucuguacagagggugaggaucagauaaccguguggggcuuccacagugacaaugaaacucagauggcuaagcucuauggggauuccaacccacagaaguuuacaucuagcgccaacggagugaccacgcacuacgucucccaaauuggcgguuuccccaaucagaccgaggacgggggacugccucagucaggccgcaucguuguggauuauaugguacagaaaaguggcaagacagggacuauuaccuaccaaagaggaauccugcucccacagaaaguguggugcgcgagcgguaggucuaaggucaucaaaggcuccuuaccccugauuggggaagcagacugucuucaugagaaguauggaggcuugaacaaaucaaagccguacuacacaggugagcacgccaaggcuauagggaauugcccuaucugggugaaaacuccccugaagcuagccaacggcaccaaauaucggccuccagcaaagcuccugaaagaacgcggauuuuucggcgcuauugccggguuucuugagggagguugggaaggcaugaucgcgggguggcauggauacacaagccacggcgcccacgguguugcaguggcugccgaucugaagaguacccaggaggcuauaaauaagauuacuaaaaaccuuaauucucucuccgaacuggaggucaagaacuuacagcgacugagcggggccauggacgagcuccauaaugaaauccuugagcuggaugaaaaaguggacgacuugagagcagauacgaucucgucucaaauugagcuagccguacugcucuccaacgaaggcaucauuaauucagaggacgagcaccuguuggcucuggaaaggaaguugaaaaagaugcucggacccagugcgguugagauaggcaacggguguuucgaaacaaagcauaaaugcaaucagaccugccuggaucggaucgcagccggaacuuuugacgcuggugaguucagcuuaccaaccuuugauucccugaacauuacagccgcaucucuaaaugacgauggccucgacaaccacaccauccugcuuuauuacagcacugccgcuucaaguuuggccgugacacugaugaucgcaauuuucgucguguauauggucucccgugauaacgugagcuguucuauaugccucuga

SEQ ID NO: 150453 - RNA, 1758 nt, Artificial Sequence
  derived and/or modified sequence opt3 from hemagglutinin__InfluenzaB__ALA08690
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacauuaccaaugggaacggauucuuugccacaauggcuugggcaguucagaaaaaugauaagaacaaaaccgccacgaauccacucacuaucgaagugccguacauauguacagagggugaggaccagauuaccgucuggggcuuccacagugauaacgaaacucagauggcuaagcuguauggggacuccaagccccaaaaauuuacaucuagcgccaauggagugaccacgcacuacgugucccagaucggcgguuucccuaaccagaccgaggaugggggacugccacagucaggccgcauugucguugacuauauggugcaaaagaguggcaaaacagggacuaucaccuaccagagaggaauccucuuaccccagaagguauggugcgcgagcgguaggucuaaagugauuaagggcucccugccucuuauaggggaagcagauuguuugcaugagaaauauggaggccugaacaagucaaagccauacuacacaggugagcacgccaaagcuaucgggaauugccccauuugggucaagacuccgcuaaaacucgccaacggcaccaaguaucggccucccgcaaaacugcuuaaggaacgcggauuuuucggcgcuaucgccggguuucuggagggagguugggaaggcaugauagcgggguggcauggauacacaagccacggcgcccacgguguggcaguugcugccgacuugaagaguacccaggaggcuauuaauaaaaucacuaagaaccucaauucucuguccgaauuagaggugaaaaaccugcaacgacucagcggggccauggaugagcuucauaaugaaauccuggaguuggacgaaaaggucgacgaucuaagagcagacacgauuucgucucagaucgagcuggccgugcuccuguccaacgaaggcauuauaaauucagaggaugagcaccuucuggcuuuggaaaggaaacucaagaagaugcugggaccaagugcgguagagaucggcaacggguguuucgaaacaaaacauaagugcaaucagaccugcuuagaccggauugcagccggaacuuuugaugcuggugaguucagccugccuaccuuugacucccuaaacaucacagccgcaucucucaaugaugacggccuggaugaccacaccauccuuuuguauuacagcacugccgcuucaagucuggccguuacacucaugauugcaauauucguggucuauauggugucccgugauaacgucagcuguucuaucugccuguga

SEQ ID NO: 150454 - RNA, 1755 nt, Artificial Sequence; identical to SEQ ID NO: 150305
  derived and/or modified sequence opt3 from hemagglutinin__InfluenzaB__ALE31766

SEQ ID NO: 150455 - RNA, 1758 nt, Artificial Sequence
  derived and/or modified sequence opt3 from hemagglutinin__InfluenzaB__ALE31768
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacauuaccaaugggaacggauucuuugccacaauggcuugggcaguuccgaaaaaugauaagaacaaaaccgccacgaauccacucacuaucgaagugcccuacauauguacagagggugaggaccagauuaccgucuggggcuuccacagugauaacgaaacucagauggcuaagcuguauggggacuccaagccucagaaauuuacaucuagcgccaauggagugaccacgcacuacgugucccaaaucggcgguuucccaaaccagaccgaggaugggggacugccccagucaggccgcauugucguugacuauauggugcagaagaguggcaaaacagggacuaucaccuaccaaagaggaauccucuuaccucagaagguauggugcgcgagcgguaggucuaaagugauuaagggcucccugccacuuauaggggaagcagauuguuugcaugagaaauauggaggccugaacaagucaaagcccuacuacacaggugagcacgccaaagcuaucgggaauugcccgauuugggucaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgacuugaagaguacccaggaggcuauuaauaaaaucacuaagaaccucaauucucuguccgaauuagaggugaaaaaccugcagcgacucagcggggccauggaugagcuucauaaugaaauccuggaguuggacgaaaaggucgacgaucuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaaugucagcuguucuaucugccuguga

SEQ ID NO: 150456 - RNA, 1758 nt, Artificial Sequence
  derived and/or modified sequence opt3 from hemagglutinin__InfluenzaB__ALE31770
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacaucucguugucaacacauaacguaauuaaugccgaggacgcaccagggggacccuauaagaucggcacuagcggcaguugcccuaacguuaccaaugggaacggauucuuugccacaauggcuugggcagugccaaagaaugauaagaacaaaaccgccacgaauccgcucacuauugaaguccccuacaucuguacagagggugaggaccagauaaccguguggggcuuccacuccgauaacgaaacucagauggcuaagcuguauggggacucuaagccucagaaauuuacaagcuccgccaauggagugaccacgcacuacgucucacaaauuggcgguuucccaaaccagaccgaggaugggggacugccccagaguggccggaucguuguggacuauaugguacagaaaagcggcaaaacagggacuauuaccuaccaacgcggaauccucuuaccucagaagguguggugcgcgucugguagauccaaagucaucaagggcucacugccacuuauuggggaagcagauuguuugcaugagaaauauggaggccugaacaagagcaagcccuacuacacaggugagcacgccaaagcuauagggaauugcccgaucugggugaagacuccucuaaaacucgccaacggcaccaaguauaggcccccagcaaaacugcuuaaggaacggggauuuuucggcgcuauugccggguuucuggagggagguugggaaggcaugaucgcgggguggcauggauacacaagucacggcgcccacgguguugcaguggcugccgacuugaagucuacccaggaggcuauaaauaaaauuacuaagaaccucaauucccugagcgaauuagaggucaaaaaccugcagcgccucucgggggccauggaugagcuucauaaugaaauccuggaguuggacgaaaagguggacgaucuacgagcagacacgaucucuucccaaauugagcuggccguacuccugucaaacgaaggcaucauuaauagugaggaugagcaccuucuggcuuuggaaagaaaacucaagaagaugcugggaccuagcgcgguugagauaggcaacggguguuucgaaacaaaacauaagugcaaucagaccugcuuagacaggaucgcagccggaacuuuugaugcuggugaguucucccugcccaccuuugacucucuaaacauuacagccgcaagccucaaugaugacggccuggauaaccacaccauccuuuuguauuacucaacugccgcuaguucccuggccgugacacucaugaucgcaauuuucgucguguauauggucagccgggacaaugugucuuguucaauaugccuguga

SEQ ID NO: 150457 - RNA, 1755 nt, Artificial Sequence; identical to SEQ ID NO: 150305
  derived and/or modified sequence opt3 from hemagglutinin__InfluenzaB__ALE31772

SEQ ID NO: 150458 - RNA, 1755 nt, Artificial Sequence; identical to SEQ ID NO: 150305
  derived and/or modified sequence opt3 from hemagglutinin__InfluenzaB__ALE31773

SEQ ID NO: 150459 - RNA, 1755 nt, Artificial Sequence
  derived and/or modified sequence opt3 from hemagglutinin__InfluenzaB__ALE31884
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgaucuucauuguguauauggucagccgcgacaaugugucuuguucaguuugccuuuga

SEQ ID NO: 150460 - RNA, 1755 nt, Artificial Sequence
  derived and/or modified sequence opt3 from hemagglutinin__InfluenzaB__ALE31885
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgaucuucguggucuauauggugagccgcgacaauguuucuuguucaauuugccuuuga

SEQ ID NO: 150461 - RNA, 1755 nt, Artificial Sequence; identical to SEQ ID NO: 150305
  derived and/or modified sequence opt3 from hemagglutinin__InfluenzaB__ALE31886

SEQ ID NO: 150462 - RNA, 1755 nt, Artificial Sequence
  derived and/or modified sequence opt3 from hemagglutinin__InfluenzaB__ALE31887
augaaggccaucauugugcugcucauggucguuaccagcaacgcugacagaauaugcacaggcaucacuuccucuaauucaccccacgugguaaaaacggcaacccagggggaaauuaacgugacaggagucaucccucuuacuaccacaccaaccaagaguuacuucgccaaucugaaagguacuaggacacggggcaaguuguguccggauugcuuaaacuguaccgaccuggauguggcgcuagggcgccccaugugcguuggaacgacuccuagcgcuaaagccuccauucuccaugaagugcgaccagucaccucuggcuguuuucccaucaugcacgaccguacaaagauaagacaacugccuaaucuucugagggguuaugagaagauccgguugucgacucagaacgugauugaugcagaaaaagccccagggggacccuaccgccucggcaccucaggcagcugcccuaaugcuacaaguaagaucggguucuuugcaaccauggccugggcuguaccaaaagacaacuauaagaaugccacgaacccgcagacuguugaggugcccuacauuuguacagaaggagaggaucagaucaccgucugggguuuccauuccgacaauaaaacucaaaugaagucucuguauggcgauagcaacccucagaaguuuacauccucagcgaauggggugaccacgcacuacgugagucagauaggagacuucccagaucagaccgaggacggcggucugccccaaagcgggagaauugucguugauuauaugaugcagaaaccuggaaagacaggcacuaucguguaccagaggggcguacucuuaccacagaaaguguggugcgcaucugggcgguccaaggucauuaaaggaucacugccccuuaucggugaagccgacuguuugcaugaggaauacggcgggcugaacaagagcaaaccguauuacaccggaaagcacgcuaaggccaucggcaauugcccuauuugggugaaaacaccccuaaagcucgcaaacgguacuaaauaucgcccuccagcuaagcugcuuaaagagcgaggguuuuucggcgccauagcgggauuucuggagggcgggugggaaggaaugaucgccgguuggcacggcuacaccagucauggggcacacggaguugcuguggccgcugacuugaagucuacacaagaggccauuaacaagaucaccaaaaaucucaacucccugagcgaauuagaggucaagaaucugcagagacucucgggcgcaauggaugaacuucauaacgagauacuggaguuggacgaaaaaguggaugaccuaagggccgauacuauuucuucccagaucgagcuggcuguacuccugucaaaugaagguaucauuaacagugaggacgaacaccuucuggcguuggagcggaagcucaaaaagaugcuggggcccagcgcaguugauaucggcaauggauguuucgagacgaagcacaaaugcaaccaaacaugcuuagaccguauugccgcuggcaccuuuaaugccggggaguucucccugccaacuuuugauucucuaaacauaaccgcagccagccucaaugacgauggacuggacaaccauacaauccuuuuguauuacucaaccgcugccaguucccuggcagugacucucaugcuggcgauuuucaucgucuauauggugagccgcgacaaugucucuuguucaaucugccuuuga

SEQ ID NO: 150463 - RNA, 1755 nt, Artificial Sequence; identical to SEQ ID NO: 150305
  derived and/or modified sequence opt3 from hemagglutinin__InfluenzaB__ALE31982

SEQ ID NO: 150464 - RNA, 1755 nt, Artificial Sequence
  derived and/or modified sequence opt3 from hemagglutinin__InfluenzaB__ALE31983
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaacaagagcaaaccguauuacaccggaaagcacgcuaaggccaucggcaauugcccuaucuggguuaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugacuugaagucuacacaagaggccaucaacaagauuaccaaaaaucucaacucccugagcgaauuagaggugaagaaucugcagagacucucgggcgcaauggaugaacuucauaacgagauccuggaguuggacgaaaaaguagaugaccuaagggccgauacuauaucuucccagauugagcuggcuguucuccugucaaaugaagguaucaucaacagugaggacgaacaccuucuggcguuggagcggaagcucaaaaagaugcuggggcccagcgcaguggauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagucacucucaugcuggcgcuuuucaucguguauauggucagccgcgacaaugugucuuguucaauuugccuguga

SEQ ID NO: 150465 - RNA, 1755 nt, Artificial Sequence
  derived and/or modified sequence opt3 from hemagglutinin__InfluenzaB__ALE31984
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaagaggaggaucagauuaccguguggggauuccauuccgacaauaaaacucaaaugaagucucuguauggugauagcaacccucagaaguuuacauccucagcgaauggcgugaccacgcacuacgucagucagaucggggacuucccagaucagaccgaagacggaggccugccccaaagcgguagaauaguuguggauuauaugguacagaaaccugggaagacaggaacuauuguguaccagaggggcguccucuuaccacagaaaguguggugcgcaucuggccgguccaagguuaucaaagggucacugccccuuauuggagaggccgacuguuugcaugaagaguacgguggccugaacaagagcaaaccguauuacaccgggaagcacgcuaaggccaucggaaauugcccuaucugggugaaaacaccccuaaagcucgcaaacggcacuaaauaucgcccuccagcuaagcugcuuaaagagcgaggguuuuucggugccauugcgggcuuucuggaaggaggcugggaggggaugauagccggauggcacgguuacaccagucauggcgcacacggggucgcuguggccgcugacuugaagucuacacaagaagccaucaacaagauuaccaaaaaucucaacucccugagcgaguuagaaguaaagaaucugcagagacucucgggagcaauggaugagcuucauaacgagauccuggaauuggacgagaaaguugaugaccuaagggccgauacuauaucuucccagauugaacuggcugugcuccugucaaaugagggcaucaucaacagugaagacgagcaccuucuggcguuggagcggaagcucaaaaagaugcugggucccagcgcagucgauauugggaauggcuguuucgaaacgaagcacaaaugcaaccaaacaugcuuagaccguaucgccgcuggaaccuuuaaugccggcgaguucucccugccaacuuuugauucucuaaacauuaccgcagccagccucaaugacgaugggcuggacaaccauacaauacuuuuguauuacucaaccgcugccaguucccuggcagugacucucaugcuggcgaucuucauugucuauauggugagccgcgacaauguuucuuguucaaucugccuuuga

SEQ ID NO: 150466 - RNA, 1755 nt, Artificial Sequence; identical to SEQ ID NO: 150305
  derived and/or modified sequence opt3 from hemagglutinin__InfluenzaB__ALE31985

SEQ ID NO: 150467 - RNA, 1758 nt, Artificial Sequence
  derived and/or modified sequence opt3 from hemagglutinin__InfluenzaB__ALE31986
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacauccgguugucgacacauaacguaauuaaugccgaggacgcaccagggggacccuauaagaucggcacuucaggcagcugcccuaacauuaccaaugggaacggauucuuugccacaauggcuugggcaguuccgaaaaaugauaagaacaaaaccgccacgaauccacucacuaucgaagugcccuacauauguacagagggugaggaccagauuaccgucuggggcuuccacagugauaacgaaacucagauggcuaagcuguauggggacuccaagccucagaaauuuacaucuagcgccaauggagugaccacgcacuacgugucccaaaucggcgguuucccaaaccagaccgaggaugggggacugccccagucaggccgcauugucaucgacuauaugguucagaagaguggcaaaacagggacuaucaccuaccaaagagguauucucuuaccucagaagguguggugcgcgagcggaaggucuaaaguaauaaagggcucccugccacuuaucggggaagcagauuguuugcaugagaaauauggaggccugaacaagucaaagcccuacuacacaggugagcacgccaaagcuguggggaauugcccgauuugggucaagacuccucuaaaacucgccaacggcaccaaguaucggcccccagcaaaacugcuuaaggaacgcggauuuuucggcgcuaucgccggguuucuggagggagguugggaaggcaugauagcgggguggcauggauacacaagccacggcgcccacgguguggcaguugcugccgacuugaagaguacccaggaggcuauuaauaaaaucacuaagaaccucaauucucuguccgaauuagaggugaaaaaccugcagcgacucagcggggccauggaugagcuucauaaugaaauccuggaguuggacgaaaaggucgacgaucuaagagcagacacgauuucgucucaaaucgagcuggccgugcuccuguccaacgaaggcauuauaaauucagaggaugagcaccuucuggcuuuggaaaggaaacucaagaagaugcugggaccuagugcgguagagaucggcaacggguguuucgaaacaaaacauaagugcaaucagaccugcuuagaccggauugcagccggaacuuuugaugcuggugaguucagccugcccaccuuugacucccuaaacaucacagccgcaucucucaaugaugacggccuggauaaccacaccauccuuuuguauuacagcacugccgcuucaagucuggccguuacacucaugauugcaauauucguggucuauauggugucccgugacaaugucagcuguucuaucugccuguga

SEQ ID NO: 150468 - RNA, 1755 nt, Artificial Sequence
  derived and/or modified sequence opt3 from hemagglutinin__InfluenzaB__ALE31988
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcgaauggggugaccacgcacuacgucagucagaucggagacuucccagaucagaccgaggacggcggucugccccaaagcgggagaauaguuguggauuauaugguacagaaaccuggaaagacaggcacuauuguguaccagaggggcguccucuuaccacagaaaguguggugcgcaucugggcgguccaagguuaucaaaggaucacugccccuuauuggugaagccgacuguuugcaugaggaauacggcgggcugaacaagagcaaaccguauuacaccggaaagcacgcuaaggccaucggcaauugcccuaucugggugaaaacaccccuaaagcucgcaaacgguacuaaauaucgcccuccagcuaagcugcuuaaagagcgaggguuuuucggcgccauugcgggauuucuggagggcgggugggaaggaaugauagccgguuggcacggcuacaccagucauggggcacacggagucgcuguggccgcugacuugaagucuacacaagaggccaucaacaagauuaccaaaaaucucaacucccugagcgaauuagagguaaagaaucugcagagacucucgggcgcaauggaugaacuucauaacgagauccuggaguuggacgaaaaaguugaugaccuaagggccgauacuauaucuucccagauugagcuggcugugcuccugucaaaugaagguaucaucaacagugaggacgaacaccuucuggcguuggagcggaagcucaaaaagaugcuggggcccagcgcagucgauauuggcaauggauguuucgagacgaagcacaaaugcaaccaaacaugcuuagaccguaucgccgcuggcaccuuuaaugccggggaguucucccugccaacuuuugauucucuaaacauuaccgcagccagccucaaugacgauggacuggacaaccauacaauacuuuuguauuacucaaccgcugccaguucccuggcagugacucucaugcuggcgaucuucauugucuauauggugagccgcgacaauguuucuuguucaaucugccuuuga

SEQ ID NO: 150469 - RNA, 1758 nt, Artificial Sequence; identical to SEQ ID NO: 150467
  derived and/or modified sequence opt3 from hemagglutinin__InfluenzaB__ALE31989

SEQ ID NO: 150470 - RNA, 1758 nt, Artificial Sequence; identical to SEQ ID NO: 150467
  derived and/or modified sequence opt3 from hemagglutinin__InfluenzaB__ALE31990

SEQ ID NO: 150471 - RNA, 1755 nt, Artificial Sequence; identical to SEQ ID NO: 150305
  derived and/or modified sequence opt3 from hemagglutinin__InfluenzaB__ALE31991

SEQ ID NO: 150472 - RNA, 1758 nt, Artificial Sequence
  derived and/or modified sequence opt3 from hemagglutinin__InfluenzaB__ALE31992
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucaggcagcugcccuaacaucaccaaugggaacggauucuuugccacaauggcuugggcagugcccaaaaaugauaagaacaaaaccgccacgaauccgcucacuauugaaguccccuacaucuguacagagcgcgaggaccagauaaccgugugggguuuccacagugauaacgaaacucagauggcuaagcuguauggcgacuccaagccucagaaauuuacaucuagcgccaauggggugaccacgcacuacgucucccaaauuggaggcuucccaaaccagaccgaggauggugggcugccccagucaggaagaaucguuguggacuauaugguacagaagaguggcaaaacaggcacuauuaccuaccaaagggggauccucuuaccucagaagguguggugcgcgagcggacggucuaaagucaucaaggguucccugccacuuauuggcgaagcagauuguuugcaugagaaauaugggggacugaacaagucaaagcccuacuacacaggcgagcacgccaaagcuauagguaauugcccgaucugggugaagacuccucuaaaacucgccaacgggaccaaguaucgcccaccagcaaaacugcuuaaggaacgaggcuuuuucggagcuauugccggcuuucuggaagggggaugggaggguaugaucgcgggcuggcauggguacacaagccacggagcccacggcguugcaguggcugccgacuugaagaguacccaggaggcuauaaauaaaauuacuaagaaccucaauucucuguccgaauuagaggucaaaaaccugcagagacucagcggugccauggaugagcuucauaaugaaauccuggaguuggacgaaaagguggacgaucuaagggcagacacgaucucgucucaaauugagcuggccguacuccuguccaacgaagggaucauuaauucagaggaugagcaccuucuggcuuuggaacggaaacucaagaagaugcugggcccuagugcgguugagauaggaaacggcuguuucgaaacaaaacauaagugcaaucagaccugcuuagaccguaucgcagccgggacuuuugaugcuggagaguucagccugcccaccuuugacucccuaaacauuacagccgcaucucucaaugaugacggucuggauaaccacaccauccuuuuguauuacagcacugccgcuucaagucuggccgugacacucaugaucgcaauuuucgucguguauauggucucccgcgacaaugugagcuguucuauaugccuguga

SEQ ID NO: 150473 - RNA, 1758 nt, Artificial Sequence; identical to SEQ ID NO: 149881
  derived and/or modified sequence opt3 from hemagglutinin__InfluenzaB__ALE31993

SEQ ID NO: 150474 - RNA, 1758 nt, Artificial Sequence
  derived and/or modified sequence opt3 from hemagglutinin__InfluenzaB__ALE31994
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucaggcagcugcccuaacaucaccaaugggaacggauucuuugccacaauggcuugggcagugcccaaaaaugauaagaacaaaaccgccacgaauccgcucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugcggacuccucuaaagcucgccaacggcaccaaauaucgcccaccagcaaagcugcuuaaagaacgaggauuuuucggcgcuauugccggguuucuggagggagguugggaaggcaugaucgcgggguggcauggauacacaagccacggcgcccacgguguugcaguggcugccgacuugaagaguacccaggaggcuauaaauaagauuacuaaaaaccucaauucucuguccgaauuagaggucaagaaccugcagagacucagcggggccauggaugagcuucauaaugaaauccuggaguuggacgaaaaaguggacgaucuaagggcagacacgaucucgucucaaauugagcuggccguacuccuguccaacgaaggcaucauuaauucagaggaugagcaccuucuggcuuuggaacggaagcucaaaaagaugcugggaccuagugcgguugagauaggcaacggguguuucgaaacaaagcauaaaugcaaucagaccugcuuagaccguaucgcagccggaacuuuugaugcuggugaguucagccugcccaccuuugacucccuaaacauuacagccgcaucucucaaugaugacggccuggauaaccacaccauccuuuuguauuacagcacugccgcuucaagucuggccgugacacucaugaucgcaauuuucgucguguauauggucucccgcgacaaugugagcuguucuauaugccuguga

SEQ ID NO: 150475 - RNA, 1755 nt, Artificial Sequence; identical to SEQ ID NO: 150464
  derived and/or modified sequence opt3 from hemagglutinin__InfluenzaB__ALN39719

SEQ ID NO: 150476 - RNA, 1755 nt, Artificial Sequence; identical to SEQ ID NO: 150305
  derived and/or modified sequence opt3 from hemagglutinin__InfluenzaB__ALN39720

SEQ ID NO: 150477 - RNA, 1755 nt, Artificial Sequence; identical to SEQ ID NO: 150305
  derived and/or modified sequence opt3 from hemagglutinin__InfluenzaB__ALN39721

SEQ ID NO: 150478 - RNA, 1755 nt, Artificial Sequence; identical to SEQ ID NO: 150305
  derived and/or modified sequence opt3 from hemagglutinin__InfluenzaB__ALN39723

SEQ ID NO: 150479 - RNA, 1755 nt, Artificial Sequence; identical to SEQ ID NO: 150305
  derived and/or modified sequence opt3 from hemagglutinin__InfluenzaB__ALN39724

SEQ ID NO: 150480 - RNA, 1755 nt, Artificial Sequence; identical to SEQ ID NO: 150468
  derived and/or modified sequence opt3 from hemagglutinin__InfluenzaB__ALN39725

SEQ ID NO: 150481 - RNA, 1755 nt, Artificial Sequence
  derived and/or modified sequence opt3 from hemagglutinin__InfluenzaB__ALN39726
augaaggccaucauugugcugcucauggucguuaccagcaacgcugacagaauaugcacaggcaucacuuccucuaauucaccccacgugguaaaaacggcaacccagggggaagugaacgucacaggagugauuccucuuacuaccacaccaaccaagaguuacuucgccaaucugaaagguacuaggacacggggcaaguuguguccggauugcuuaaacuguaccgaccuggauguugcgcuagggcgccccaugugcgugggaacgacuccuagcgcuaaagccuccauccuccaugaaguccgaccagugaccucuggcuguuuucccauuaugcacgaccguacaaagaucagacaacugccuaaucuucugagggguuaugagaagauacgguugucgacucagaacguaaucgaugcagaaaaagccccagggggacccuaccgccucggcaccucaggcagcugcccuaaugcuacaaguaagauuggguucuuugcaaccauggccugggcuguuccaaaagacaacuauaagaaugccacgaacccgcagacuguggagguccccuacaucuguacagaaggagaggaucagauuaccgugugggguuuccauuccgacaauaaaacucaaaugaagucucuguauggcgauagcaacccucagaaguuuacauccucagcggacggggugaccacgcacuacgucagucagaucggagauuucccagaccagaccgaggauggcggucugccccaaagcgggagaauaguuguggacuauaugaugcagaaaccuggaaagacaggcacuauuguauaccagaggggcgugcucuuaccacagaaagucuggugcgcaucugggcgguccaaggugaucaaaggaucacugccccuuauuggugaagccgacuguuugcaugaggaauacggcgggcugaauaagagcaaaccguauuacaccggaaagcacgcuaaggccaucggcaacugcccuaucuggguuaaaacaccccuaaagcucgcaaaugguacuaaauaucgcccuccagcuaagcugcuuaaagagcgaggguuuuucggcgccauugcgggauuucuggagggcgggugggaaggaaugauagccgguuggcacggcuacaccagucauggggcacacggaguggcugucgccgcugauuugaagucuacacaagaggccaucaacaagauuaccaaaaaccucaauucccugagcgaauuagaggugaagaaccugcagagacucucgggcgcaauggacgaacuucauaaugagauccuggaguuggaugaaaaaguagacgaucuaagggccgacacuauaucuucccagauugagcuggcuguucuccugucaaacgaagguaucaucaauagugaggaugaacaccuucuggcguuggagcggaagcucaaaaagaugcuggggcccagcgcaguggacauuggcaacggauguuucgagacgaagcacaaaugcaaucaaacaugcuuagaucguaucgccgcuggcaccuuuaacgccggggaguucucccugccaacuuuugacucucuaaauauuaccgcagccagccucaacgaugacggacuggacaaucauacaauacuuuuguauuacucaaccgcugccaguucccuggcagucacucucaugcuggcgaucuucauuguguauauggucagccgcgauaacgugucuuguucaaucugccuuuga

SEQ ID NO: 150482 - RNA, 1755 nt, Artificial Sequence; identical to SEQ ID NO: 150468
  derived and/or modified sequence opt3 from hemagglutinin__InfluenzaB__ALN39727

SEQ ID NO: 150483 - RNA, 1755 nt, Artificial Sequence; identical to SEQ ID NO: 150305
  derived and/or modified sequence opt3 from hemagglutinin__InfluenzaB__ALN39728

SEQ ID NO: 150484 - RNA, 1755 nt, Artificial Sequence; identical to SEQ ID NO: 150305
  derived and/or modified sequence opt3 from hemagglutinin__InfluenzaB__ALN39729

SEQ ID NO: 150485 - RNA, 1758 nt, Artificial Sequence
  derived and/or modified sequence opt3 from hemagglutinin__InfluenzaB__ALN39730
augaaggccaucauugugcugcucauggucguuaccagcaacgcugacagaauaugcacaggcaucacuuccucuaauucaccccacgugguaaaaacggcaacccagggggaggugaacgucacaggagugauuccucuuacuaccacaccaaccaagagucauuucgccaaucugaaagguacugaaacaaggggcaaguuguguccgaaaugcuuaaacuguaccgaucuggacguugcgcuagggcggcccaagugcacgggaaagaucccuagcgcucgcguguccauucuccacgagguccgaccagugacuucuggcuguuuucccaucaugcaugaucguaccaaaauaagacaacugccuaaucuucugagggguuacgaacacguacgguugucgacacauaacguuaucaaugccgaggacgcaccagggggacccuauaagauuggcacuucaggcagcugcccuaacaucaccaaugggaacggauucuuugccacaauggcuugggcagugccgaaaaaugauaagaacaaaaccgccacgaauccacucacuauugaaguccccuacaucuguacagagggugaggaccagauaaccguguggggcuuccacagugauaacgaaacucagauggcuaagcuguauggggacuccaagccucagaaauuuacaucuagcgccaauggagugaccacgcacuacgucucccaaauuggcgguuucccaaaccagaccgaggaugggggacugccccagucaggccgcaucguuguggacuauaugguacagaagaguggcaaaacagggacuauuaccuaccaaagaggaauccucuuaccucagaagguguggugcgcgagcgguaggucuaaagucaucaagggcucccugccacuuauuggggaagcagauuguuugcaugagaaauauggaggccugaacaagucaaagcccuacuacacaggugagcacgccaaagcuauagggaauugcccgaucugggugaagacuccucuaaaacucgccaacggcaccaaguaucggcccccagcaaaacugcuuaaggaacgcggauuuuucggcgcuauugccggguuucuggagggagguugggaaggcaugaucgcgggguggcauggauacacaagccacggcgcccacgguguugcaguggcugccgacuugaagaguacccaggaggcuauaaauaaaauuacuaagaaccucaauucucuguccgaauuagaggucaaaaaccugcagcgacucagcggggccauggaugagcuucauaaugaaauccuggaguuggacgaaaagguggacgaucuaagagcagacacgaucucgucucaaauugagcuggccguacuccuguccaacgaaggcaucauuaauucagaggaugagcaccuucuggcuuuggaaaggaaacucaagaagaugcugggaccuagugcgguugagauaggcaacggguguuucgaaacaaaacauaagugcaaucagaccugcuuagaccggaucgcagccggaacuuuugaugcuggugaguucuuucugcccaccuucgacagccuaaacauuacagccgcaucccucaaugaugacggccuggauaaccacaccauccuuuuguauuacucuacugccgcuagcucacuggccgugacacucaugaucgcaauuuucgucguguauauggucagucgugacaauguguccuguagcauaugccuguga

SEQ ID NO: 150486 - RNA, 1755 nt, Artificial Sequence; identical to SEQ ID NO: 150305
  derived and/or modified sequence opt3 from hemagglutinin__InfluenzaB__ALN39732
